United States Patent 8,299,321 (NUCLEIC ACID MOLECULES AND OTHER MOLECULES ASSOCIATED WITH PLANTS AND USES THEREOF FOR PLANT IMPROVEMENT) - sequence listing, part 4

SEQ ID NO: 9264 - DNA, 1743 bp, Glycine max
tctcaccccagtttcactttctcattattttctctcctattgataaagaaacagagagagagagaaaaaaatgcctgcggtaggaggtattagcaacggagggggcaaggagtaccctggaagcctcactccttttgtgacggtaacatgtatagttgcagccatgggtgggttaatcttcggttacgatatcggaatttcaggtggggtgacatccatggatccgtttctgctcaagtttttcccgtcggtgttccggaagaagaattccgacaaaacggtgaaccagtactgtcaatacgacagccagacactgacgatgttcacgtcgtcgctgtatctcgccgcgttgctgtcgtcgttggttgcctccaccgtcacacgtaggttcggccgaaaactctccatgcttttcggaggcttgcttttcctcgtcggtgcccttatcaacggttttgcccaacacgtgtggatgctcatcgtgggtcggatcttgctcgggttcggtatcgggtttgccaatcagtctgtgccactctacctatctgaaatggctccatacaaatatagaggagcattgaacattggctttcaattgtcaatcacagttggtatcctcgtggccaatgtgttgaactacttctttgctaaaatccatggtggctggggatggagattgagtttgggaggtgctatggtccctgcccttataatcacaataggatcactagtccttccggacactcccaattccatgattgaaaggggtgatcgtgaaaaggccaaggctcagcttcggagagttcgcggcatcgacgatgtggaagaagagttcaatgaccttgttgcagctagtgaatcctccagaaaagtggagcacccgtggaggaacttgttgcaaagaaagtacagaccccacctcaccatggctgtgctgattccattcttccagcaactcactggaatcaatgtcatcatgttttacgcgccggtgttgttcagctccatcgggtttaaggatgattctgctctaatgtcagctgtgatcactggcgttgttaatgttgtggcaacttgcgtctcaatttatggtgttgacaagtggggtaggagagcccttttccttgaaggtggagttcaaatggtcatttgccaggctgtagttgcagctgctataggagcaaagtttggaattgatggaaaccctggtgatttgccaaaatggtatgcagttgttgtggttctcttcatttgcatttacgtatcagcatttgcctggtcatggggtcccctaggttggttggtgcctagtgagatctttcccttggagatccgttcggctgctcaaagtataaatgtgtcggtgaacatgtttttcactttcttgattgcacaagtcttcttgacaatgctttgccacatgaagttcggcttgttcatcttctttgcctttttcgtgttgatcatgacattcttcatctacttcttcttgcctgaaaccaagggcattcccattgaagaaatgaaccaggtttggaaggcacaccccttctggtccagattcgtggagaatgatgattatggcaatggtgttgagatggggaggggaactgctatcaaagaagtgtagttacttgtttatttttctcaatgactagcgttttagcttttgttggtaaatcatactattggtggtgtcaatgtattgaattgttcctataaattaaaaagggttattttctc

SEQ ID NO: 9265 - DNA, 2359 bp, Glycine max
atttattttctttctgcttctcatggatctctcctcactctcttcataccgcactgtcggagtaacaccttctgatcctcgaaaatcacttcctcaatggggtcttcatttcctctcctacactcacaggctcaaccaggttactgccatttatgaatgcaatgcctcctcttttataactacctttgtttattgctgaattagtcaatgggtgtatatatatttagattaagaaaaggtcaagtggggtatatgcatcactatccgagagagagagaggagagtattattcccagagaccgccaactccgctactagacaccgtcaactatcctattcatatgaaaaatctctctaccaatgagctgaaacaactcgcagatgaactgcgttctgatgttattttcagtgtttctagaactgggggccatttgggctcaagtcttggtgtggtggaactcaccgttgcactccactatgtctttaatgcccctcaggacaagatactctgggacgttggtcaccagtcttacccgcataagatactcaccggtaggagggacaagatgcataccatgaggcagacaaatggcttgtctggcttcaccaaacgttccgagagtgaatttgattgttttggcactggtcacagctccaccactatttcagccggacttggaatggctgttgggagagatctgaagggaagaaagaataacgtggttgctgttataggtgatggtgccatgacagcaggccaagcttatgaagccatgaacaatgctggatatcttgattctgacatgattgttattctaaatgacaacaaacaggtctctttaccaactgctactcttgacggacccataccacctgtaggagccttgagtagcgctctcagtagattacaatcaaataggcctcttagagaattgagagaggttgccaagggagttactaaacgaattggaggtcctatgcatgaattggctgcaaaagttgacgagtatgctcgtggcatgatcagtggttctggatcatcactttttgaagagcttggactctactatattggtcctgttgatggtcataacataaatgatcttgttgccattctcaatgaagttaaaagcactaacacaaccggtcctgtattgatccatgttatcactgaaaaaggccgtggatacccatatgcagaaaaggcagctgacaaataccatggggttaccaagtttgatccaccaactgggaagcaattcaaatccaaggctaccactcggtcttatacaacatactttgctgaagctttgattgcagaagccgaagctgacaaagacgttgttgcaatccatgctgctatgggaggtggaactggcatgaatctcttccatcgccgtttcccaacaagatgctttgatgtggggatagcagaacagcatgctgttacatttgctgcaggtctggcttgtgaaggtcttaaacctttctgtgcaatttactcatcattcatgcagagggcttatgaccaggtggtgcatgatgtggatttgcagaagctgcctgtaagatttgcaatggacagggctggattagttggagcagatggtcccacacattgtggttcttttgatgtcacatttatggcatgcctgcctaacatggtggtgatggctccttctgatgaagccgaacttttccacatggttgccactgcagcagccattaatgatcgacctagttgtttccgatatccaaggggaaatggcattggtgttcaactaccaactggaaataaaggaactcctcttgagattgggaaaggtaggatattgattgaaggggaaagagtggctctcttgggctatggatcagctgttcagaactgtttggctgcagcttccttagtggaacatcatggtttgcgtgtaacagttgctgatgcacgtttctgcaaaccactggatcgttccctgattcgcagcctggcaaaatcacatgaggttttgattacagttgaagaaggatcaattggaggatttggttctcatgttgctcagttcatggcccttgatggccttatagatggcaaattgaagtggaggccaatagttcttccggatcgttatatcgaccatggatcacctgctgaccaattgtctttagccggtcttacaccatctcacatagcagcaacagtgttcaacatactaggacaaacaagagaggcactagaggtcatgtcttagaaatattaaggggttcaatttttcactttacacgatgtacaatgcataacatgattcaccacgtgtaatataatatgaaaaagtaatgtaatactgtgaaattttgaagt

SEQ ID NO: 9266 - DNA, 1458 bp, Glycine max
acctcttttgcctttagaaacaggtattcgacttcttgttttttttgttggaaacataattgttataaattctcccttctgacttgtgcagggagtttcctataaaaaatgggaaggctttaagctttatatacggtagcaaacagttgaaaacaaaggggggtctggcggctagaactgccacaagcaacgtgttctgtagtgctggttacaagtgtgcaatgagggcactccaatcccaatgctgcagcccggatgaagtgatatttggtcctgattttttccaatcactgtactgccatctgctgtgtggtctgattttccgggaggaagttgagtttgtatcttccacatttgcacatagcattgtccatgcttttagaacctttgaacaagtgtgggaagagctgtgcaatgatatcagagaaggggttctcaccagaaatgtcaccgttccttccattcgaatggccatgtctaaactgctcaaaccaaaccctgaattagcaaacgcgatccacaaaaaatgcacgggattgagcaactggtacgggttgataccggagctttttcccaatgcaaagtatatttatggcatcatgaccgggtcgatggaaccttatttgaaaaaaatgagacattatgccggggagctgcctttgttgactgctgactatggatcctctgagggatggatagcagcaaatgtgaacccacaacttcctcccgagtatgccacttatgccgtgcttcctcacattggttactttgaattcattcctctcttagagcttgagaacaccaagcctctgggcctgactcaagtcaaggttggtcaagagtatgaaattgttatgacaaatccagcaggtttataccgttatagattgggggatgtggtgaaggttatgggattccacaattcaactccagaactcaagtttattcgaaggagcagtcttctgctcaacattaacatcgacaagaacactgagaaggatttacaattagccgtggaagctgcagggaagttgctagcagaggagaaactggaagtagttgacttcagtagccaggttgatttatccaaagaaccagggcactatgtcatcttctgggaaatcagcggagacgcgagccaagaactactccatgaatgctgtaactgtttggacaagtctttcgttgatgcaggctacaccagttcgcgcaaagtgaactgcattggtgccctcgaactacgacttgttcggagaggaacattccagaagattcttgatcattacctaggactaggaaccgctgttagtcagtacaagacaccaagatgtgttggtcctacaaacaccagagtgttgcaaatcttgagtgaaaatgttgtcaacaactatctcagtaccgctttcaattgaataaaaatttgggaataacaatctattataaagtttacttagtttt

SEQ ID NO: 9267 - DNA, 1238 bp, Glycine max
cgaaaacagtgttccaaaatccaaacacactctctctccccatggcgttgaacaatggcgtccccgccaccggcaccggcctcatcgtcagcttcggtgagatgctcatcgacttcgtccccaccgtctctggcgtgtccctggccgaggcccctggcttcctcaaggcccccggcggcgcccccgctaacgtcgccatcgccgtgtcgcgcctcggcggcaaagccgccttcgtcggcaagctcggcgacgacgagttcggccacatgctcgccggaatcctcaaggaaaacggcgttcgcgccgacggcatcaactttgaccagggcgcacgcaccgccctggccttcgtgaccctacgcgccgacggggagcgtgagttcatgttctacagaaaccccagcgccgacatgctcctcaagcccgaagaactcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggagaaggctgatttgatcaaggtcagtgatgcggagcttgagttcctcacaggaagtgacaagattgatgatgaatctgctttgtcattgtggcaccccaatttgaagttgctccttgtcactcttggggaacatggttccagatactacaccaagagtttcaaaggatcggtagatgctttccatgtcaatacagttgatacaactggtgccggtgattcctttgttggtgctttattggccaagattgtcgatgatcagtccatacttgaagatgaaccaaggttaagagaagtactaaagtttgcaaatgcatgtggagctattacaactacccaaaagggagcaattccggcccttcccaaagaggaggctgcactgaaactgatcaaaggggggtcatagaatcttttggcaaaatgcaaaagtgctagcatgatttcgttttcttcccctaatgtttaaattttccgttggatttgcttgctataagtttaggagggaacttttgttttttctcctatgcactgttttcaggttttgccaaataacgctttctttcaaattttgagattagcgattgaatgaaaatttgaatcataagct

SEQ ID NO: 9268 - DNA, 1275 bp, Glycine max
ataatctccaccaaacccctcttttactctcctctctcctctctcgaaaacagtgttccaaaatccaaacacactctctctccccatggcgttgaacaatggcgtccccgccaccggcaccggcctcatcgtcagcttcggtgagatgctcatcgacttcgtccccaccgtctctggcgtgtccctggccgaggcccctggcttcctcaaggcccccggcggcgcccccgctaacgtcgccatcgccgtgtcgcgcctcggcggcaaagccgccttcgtcggcaagctcggcgacgacgagttcggccacatgctcgccggaatcctcaaggaaaacggcgttcgcgccgacggcatcaactttgaccagggcgcacgcaccgccctggccttcgtgaccctacgcgccgacggggagcgtgagttcatgttctacagaaaccccagcgccgacatgctcctcaagcccgaagaactcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggagaaggctgatttgatcaaggtcagtgatgcggagcttgagttcctcacaggaagtgacaagattgatgatgaatctgctttgtcattgtggcaccccaatttgaagttgctccttgtcactcttggggaacatggttccagatactacaccaagagtttcaaaggatcggtagatgctttccatgtcaatacagttgatacaactggtgccggtgattcctttgttggtgctttattggccaagattgtcgatgatcagtccatacttgaagatgaaccaaggttaagagaagtactaaagtttgcaaatgcatgtggagctattacaactacccaaaagggagcaattccggcccttcccaaagaggaggctgcactgaaactgatcaaaggggggtcatagaatcttttggcaaaatgcaaaagtgctagcatgatttcgttttcttcccctaatgtttaaattttccgttggatttgcttgctataagtttaggagggaacttttgttttttctcctatgcactgttttcaggttttgccaaataacgctttctttcaaattttgagattagcgattgaatgaaaatttgaatc

SEQ ID NO: 9269 - DNA, 2335 bp, Glycine max
ggatctctccgctctctcatcataccgcactctcgggaagttacttcctcttccctctcactctcaatggggtctccatttcctcgcccacgctcaccccctccaccagatgaagaaaaggccatgtggggtatatgcatccctctccgagagtggagagtattattcccaccgaccgccaactcccctactagacaccgtcaactatcctattcatatgaagaatctctctaccaaggagctgaaacaactcgcggatgaactgcgttctgatgttattttcagtttttctagaactgggggccatttgggctcaagccttggtgtggtggaactcactgttgcacttcactatgtcttcaatgcccctcaggacaagatactgtgggacgttggtcaccagtcttaccctcataagatactcaccggtagaagggaccagatgcataccatgaggcagacaaatggcttatctggcttcaccaaacgttctgagagtgaatttgattgttttggcactggtcacagctccaccaccatttcggcaggacttggaatggctgttgggagggatctgaagggaagaaagaataacgtggttgctgttataggcgatggtgccatgacagcagggcaagcttatgaagccatgaacaatgctggatatcttgattctgacatgattgttattctaaatgacaacaagcaggtttctttaccaactgctactcttgatggacccataccacctgtaggagccttgagtagcgctctcagtagattacaatcaaataggcctcttagagaattgagagaggttgccaagggagttactaaacgaattggaggtcctatgcatgaattggctgcaaaagttgacgagtatgctcgtggcatgatcagtggttctggatcatcactttttgaagagcttggactctactatattggtcctgttgatggtcataacatagatgatcttgttgccatcctcaacgaagttaaaagtactaaaacaaccggtcctgtattgattcatgttatcactgaaaaaggccgtggatacccctatgcagaaaaggcagcagacaaataccatggggttaccaagtttgacccaccaactggaaagcaattcaaatccaaggctaccactcagtcttacacaacatactttgctgaggctttgattgcagaagccgaagctgacaaagacgttgttgcaatccatgctgctatgggaggtggaactggcatgaatctcttccatcgccgtttcccaacaagatgctttgatgtggggatagcagaacagcatgctgttacatttgctgcaggtctggcttgtgaaggtcttaaacctttctgtgcaatttactcatcattcatgcagagggcttatgaccaggtggtgcatgatgtggatttgcagaagctgcctgtaagatttgcaatggacagggctggattagttggagcagatggtcccacacattgtggttcttttgatgtcacatttatggcatgcctgccaaacatggtggtgatggctccttctgatgaagccgaccttttccacatggttgccaccgcagcagccattaatgatcgacctagttgttttcgatacccaaggggaaatggcattggtgttcagctaccaactggaaataaaggaactcctcttgagattgggaaaggtaggatattgattgaaggggaaagagtggctctcttgggctatggatcagctgttcagaactgtttggctgcagcttccttagtggaatgtcatggcttgcgcttaacagttgctgatgcacgtttctgcaaaccactggatcggtccctgattcgcagcctggcaaaatcacatgaggttttaatcacagttgaagaaggatcaattggaggatttggttctcatgttgctcagttcatggcccttgatggccttctagatggcaaattgaagtggcggccaatagttcttccggatcgttatatcgatcatggatcacctgctgaccaattgtctttagccggtcttacaccatctcacatagcagcaacagtgttcaatgtactaggacaaacaagagaggcactagaggtcatgtcatagaaatattaaggggttcaatttttcacttcacacgatgtacaaagtataacatgattcaccatgtgtaatatgaaaaagtaatgtaatattgtgaaattttgaagtgtatgatgtagattgtcatatagtaaaacgactagttataaaagagaaaaatgttaaacttttctttaagtgcaaaagaatagcctttctgatatggtctaaact

SEQ ID NO: 9270 - DNA, 847 bp, Glycine max
atttacaccttcatatcaatgtggtttgttggtggcctgactgcctttcatttatatcttataagtacaaatcagactacatatgagaacttcagataccgatatgatcgacgggccaacccgtataacacaggagtgttcaataatttcttagagatattctgcaccagcattccccaatcaaagaacaatttcagggcaaaggtaccaatggaaccagtattacctgctcgatcggtgggtggaggctttatgagcccgagcatgggaaaagctgttgacgacatagagatgggcaggaaaaccgtgtgggccgacatgggtactgctcttgatccttctgaaggtcaattaaatgaccgcgtggctgtaaaggatggggaatttggtgagttgtctccagaaattaggacaacagtagacgaaactagtcaccgtgccggaatgcatcccaggagatccagctggggaagaaaaagtggaagctgggaaatgtcccctgaagttcttgctttggcagccaaggttggggaatcaaatcgaatgggtggaggtagcagcagtttgaccactgagaacaggcatacatagccactgaaattatattagtctggcaaagggttttatttgttgtaattaaacggtgttacatttctgatgcagtaaatcatcagcaaaattaattgtatttgcaatgtgggggatgagggctttggagggtgtttgttagtgttgttttcgccatattgtgcttctagggagttgttgtgttgttgtgagtgagcttttttcctttgccttgtgttgtatcacgcttcccaattaactatttgtcttaccaattacc

SEQ ID NO: 9271 - DNA, 1731 bp, Glycine max
ataaatgggttttggaggaaggaagagatccttgtgttgtgggttgaggtgagaagggaagggatgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgagcgattagatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagatacaagggagggcatgctataatacactggaaagagacacagcattgctattccctagaagtggaaacaaaacgagtttgggattatgtgggagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctattgtcaatgagtacaatgaattgcttgctactcaacttgaaaaccaaaaattatattttgaatccttgttacaagaagtaaaagaagaatctgagagaaaaatttccaaagctgttcagaaggctatcagtcttaaacagcagaagattcagtccaagattgacagatgtaagaaagagaagaaatttctggatgatcttaatgagaatcttgtgaaaaatgaggacatttggaaaactaagatacttgcgattgaagagagggagaaaaaaaccacgagactgatgggtgatagagtagcggacctggaaatgcagcttggtgatctcatggtttgtcttgagggtgggaggacggtagaacagctggcagcttcagatgagattaaagaagggattatcttggacaaatcaatagaatcctcgacaactagtggctctgacctggtgggaagagacgcataacagaagaatggttccttttaatgacagaagaatgattccttttaatggactacattgcacggactgacctataccatgtttataatcacagatttatagaaactacactcgtggatccacagttgacatgttttcactctaattttttcccatataaaactcccagtgtatgtatctgtttagatttgtaaataaaaagatttccaactaccagtataaattcttaatatttat

SEQ ID NO: 9272 - DNA, 969 bp, Glycine max
gcccaggcattggtgggttcttaccctttattattattattattggagatgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaagtattcaacaaaatgtagattattagaagtgaccgggttcgcttcctttatatatgttttaagtgtttcactcaaaaccagttgagtccagtgatgtttgctgtttaaaaacaactcctgcaaagtaagtaaatcctagggatgaggttctgcaggcagaattgcatgtacttgaattcgtattctattttcttttcgtagattgattcataggaagtgttatatatgcccgagttaatggtcaatgctttggccgtttcttactttctatactttgtcatcataaaaaaattattcttacct

SEQ ID NO: 9273 - DNA, 1622 bp, Glycine max
cgacgctctaaaaaactcgaaactctgaaaaaagtacaaaccgctgcgaacaatggcaacgatcaaggccgtgaaagctcgccagatcttcgacagccgtggaaatccaaccgttgaagttgacgttattctcagcgatggaaccttccacagagctgctgtccctagcggcgcttcaacaggtgtttatgaggctttggaattgagggatggaggctcagactacctcgggaaaggtgttcttaaggctgtggagaatgttaattcaattatagcacctgctctgcttggcaaggacccaaccaagcagactgaaattgacaattttatggtacagcagcttgatggaactgttaatgaatggggatggtgtaagcagaagcttggagctaatgctattttggcagtgtcacttgctgtctgtaaggctggtgctgcagtgaagaaaattcctctgtacaagcacattgctaatctggctggaaacaagactttggtactacctgtgccttcattcaatgttatcaatggaggctcacatgcaggaaataagctagcaatgcaggaatttatgattctccctgttggggcatcttccttcaaagaagccatgaaaatgggcgtagaagtataccatcatctaaaggctgtgattaaaaagaaatacggacaggatgctactaacgttggtgatgaaggtggctttgctcctaatatccaggaaaacaaagaaggtcttgaacttctgaagactgccattgctaaagctggttacactggaaaggttgtaattgggatggatgttgctgcttcagaattttacgataacaaggataaaacctatgacttgaattttaaggaagagaataatgatggatcacagaaaatctcaggagacagcttaaagaatgtgtacaaatcatatgtgacagattatccaattgtgtccattgaggatccatttgatcaggatgactgggagcactatgcgaaattaacagctgaagttggccagcaagtgcagattgttggtgatgatctcctcgtcaccaacccgaagcgtgtggagaaagcaatcaaggagaaggcttgcaatgcccttctgttgaaggtgaatcaaattggtagtgtaactgaaagtattgaagctgtgagaatgtctaaacaagctggttggggtgtcatggctagccacaggagtggtgaaactgaggataccttcattgctgacctatcagttggattagcaactggccagatcaagactggagctccctgccgatctgaaaggcttgccaagtacaaccagcttctgaggattgaggaggaactgggttctgcggctgtctatgctggtgccaaattcagagccccagtggaaccctattgattgtttagcccaagatcattaagcaacatttgaataagattctattgatgactgcatggagcatgtattttttgcgaaaattaaacttgtctactatcaagagaacataggtttttcgagcgtggaattttgaagcgagaaaataggggcagtagtcaataaatttgtctatggtttggcttgttatagacaattatcatgtgttagtacaaattttggatgaattacgtct

SEQ ID NO: 9274 - DNA, 1955 bp, Glycine max
accctctcaaaacaaaacctcatcatcatctaactcattcacatttttctctatcatctcgtttctactgtttcctcatggacactaacattggatctctatccctcgacgcgtgcaagcctgctaacaacgacgtcggttgtcccccgaacggagccgtttcagcaatcaaaccctccgtccccgcaaccacgatgacgtcctcggatgccacgctaggacgccacctagcacggagactcgtgcaggtgggggtgacagacgtcttctccgtgccgggtgactttaacctcaccctcctcgaccacctcatcgcggagccgcagttgaaaaacataggatgttgtaacgaactcaatgccgggtacgctgctgacggctacgcgcggtgcaggggcgtgggcgcgtgtgtcgtcacgtttactgttggaggactgagtgtaatcaacgcgattgcgggcgcgtacagcgagaatcttccgctgatctgtattgtgggtgggcccaatacgaacgattttggtaccaacagaatcttgcatcacaccattggattgtccgatttcagccaggagctcaggtgcttccaaacagttacatgctatcaggctgtggtgaataacatagaagatgctcatgaattgattgatactgcaatctcaacctgcctgaaagaaagcaagcctgtgtacataagcataagttgtaacttgcctggcattcctcaccccacattcagtcgcgagccggttccattttctctgtctccaagattgagtaacaagatggggttggaggctgcagtggaagcagcagcagagttcctaaacaaggcagtgaagcctgtaatggttggaggtcctaaactaagggtggctaatgcatgtgatgcatttgttgagcttgctgatgcatgtggctatccatttgctgtgatgccatcagccaagggactagtcccggagcacaaaccccacttcattggcacattctggggtgctgtgagcaccgcattctgtgctgaaatcgtcgaatctgctgatgcatacttgtttgctggccccattttcaatgactacagctctgttgggtactcactcctcctcaagaaggagaaggccatcatcgtgcagccggagcgcgttgtgatctccaatggacccgcattcgggtgtgtcctcatgaaggacttcctcagggaactcgcaaagcgtctcaagcacaacaacactgcttatgaaaattactcaaggatttttgtccctgagggaaagcctgtgaaagctgaacccagagagcctttgagggttaatgttctgtttaagcatatacaagatatgctgtctggcgaaaccgcggtgattgctgagacaggggactcttggtttaactgccagaagctgaagttgccaaaggggtgtgggtatgagttccaaatgcaatatggttcaattggttggtctgttggtgctacacttggttatgctcaggcggttcctgagaagcgagtgatttcttgcattggtgatggaagctttcaggtgacagctcaggatgtgtccacaatgctgcgaaatgagcagaagaccatcatcttcctgataaacaatggtggatacaccattgaagttgaaattcatgatgggccatacaatgtgattaagaactggaactacactggcttggttgatgcaatccacaatggtgaaggaaaatgctggaccactaaggttacatgtgaagaggagcttgttgaggcaattcagacagcaacaggtgacaagaaagattgcttgtgcttcattgaagtgattgttcacaaggatgacacaagcaaagaattgcttgaatggggctcaagggtttgtgctgctaacggtcgtcctcccaatcctcagtgaatttcaaacacttaattgagccattacaaatttgctggagtttctccctatttc

SEQ ID NO: 9275 - DNA, 1871 bp, Glycine max
aaggttgtggtaaataaataacctaacctaacccttgcgacttgcgacttgcgagtgagactgaggttgggtttggaaggcaagggcttgtgttgtcacaatccaagagagaagtaatggcgaacatagacatcgaagggatcttgaagcagcagcagccttatgatgggcgcgttccgaagacgaagatagtgtgtactttgggccctgcttctcgctccgtagaaatgaccgagaagcttctgagggcagggatgaacgttgctcgtttcaatttctctcatggcacccacgactatcaccaggaaaccctcaacaatctcaagactgccatgcacaacactggcatactctgtgccgtcatgcttgacactaagggacctgagattcggactggttttctgaaagatggaaaacctattcaacttaaagaagggcaagaagtcaccataactactgattatgacattaagggggatccggagatgatatccatgagttacaagaagctgcctgtccacttgaagcctggaaataccatactgtgctctgacgggacgattactctcactgtcttgtcttgtgaccctgatgctggtactgttagatgtcgttgtgaaaacactgcaacgttgggtgagagaaaaaatgttaaccttcctggtgttgtggtggatctacccacacttactgagaaggataaggaagacattcttggatggggtgtacccaacaagattgacatgattgctctttcatttgttcgtaaaggctcggatcttgttaatgtccgcaaggttctggggccacatgcaaagaatattcagttgatgtcaaaggttgagaatcaggagggagtcctgaattttgacgaaatcctgcgggagactgatgcattcatggtggcacgtggtgatcttggaatggagatcccagtagaaaagattttcctggcacagaagatgatgatatacaagtgtaatcttgttgggaagccagtggtgactgctacccaaatgcttgaatcaatgataaagtctcccaggccaacccgagctgaagcaactgatgtagctaatgcagttcttgatggaacagattgtgtgatgcttagtggtgaaagtgctgctggggcatacccagaacttgctgtgaaaatcatggctcgcatttgcattgaagcagaatcatcccttgactatggtgccatcttcaaagagatgataaggtctaccccattgcctatgagtccattggagagccttgcatcatctgctgtccgcacagcaaacaaggccaaagcaaaactcattgttgtgctgacacgtggcgggtctacagccaagttagttgccaagtataggccagcggttccaatattgtcggtggtggttccagtgttgagcacggactcatttgattggacctgcagtgatgagacgccagcaaggcacagcctgatatacaggggcttgattcctatactgggcgagggatctgcaaaggctaccgatgcagaatccacagaggtcattctcgaagctgctcttaagtccgcaacagaaagggccctttgtaagcctggtgatgcagttgttgccctgcatcgtattggagctgcctctgtcataaagatctgcatagtcaaataatgcatgctcaactcaacgtgccgccaactaatgcaggattatgttttgccttttatttctttctttctgctgtttatccgtatcataaaatggaggatttagttactagctgtagatcgagtgttttttggtatactctgtttatattgcggagtacttctaaatcagattatcatggaaataatactcttaccttttaaaatgtgattggttttgcgg

SEQ ID NO: 9276 - DNA, 628 bp, Glycine max
tggttattcctcttcccattctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctgttggctgtgaggaacgatgaggagttggggaaattgcttgctggtgtcaccattgctcatggtggtgttcttccaaacattaaccctgttttgctacctaagaagactcaggttgctaaggaaccaaaatctccatccaaggctaccaagtctccaaagaaagcttagatgtttttattttattttaatatatgtatatcagtgtttagatgctttttatgtaaaagaaaatagtatctattggaaacactgtaattcttatcgtcttgcatgtaggagtttgctaaataatgaaaatatcttattattttgggtc

SEQ ID NO: 9277 - DNA, 1915 bp, Glycine max
ctaagctccttgtgcggccaccattcttgttggagatttcaactctttctccttcagacttcttgggtttatgtgatgatggctctcaatatctcttctcctgctgaagtcaagtccatttttttcgctgattacttcaagtctaactgcatcactgcaaagttcacaggtggttttgcttttaagagaaaagagcgtggagctgcatctggagggcgagtttgttgctcagtgctggcaccaccaccaccaccggcctggccgggacgagcggttccagaacaaggtagcaagacttgggatggaccaaaacccatttcaattgttgggtgtactggttcaattggaactcagacactagatattgtggcagagaatccagataagtttaaagttgtggcacttgcagctggttcaaatgttactgttcttgcagaccaggtaaaaagatttaagcctcaacttgttgctgttagaaatgagtccctaattgctgaacttaaagaggccttgcatgacgttgaagaaaaacctgagatcatccctggagagcagggaatcattgaggttgctcgtcacccagatgcagtcagtgtagtcacaggaatagtaggctgtgcaggactgaagccaacagttgctgcgatagaagcagggaaatacatagctttagccaacaaagagacattgattgctggaggtccttttgttcttcctcttgctcagaagcataatgtaaaaatacttccagctgattcagaacattctgccatctttcagtgtatccaggggttgccagagggtgcacttaggagagttattttaactgcatctggaggtgctttcagggattggccagttgataaactgaaagatgttaaagttgctgatgcattaaaacatcctaactggaatatggggaaaaagataactgtggactctgctaccctttttaataagggtctagaagtaattgaagcacattacttgtttggagctgactatgatcatattgagattgtcattcatccacaatcaatcatacattcaatgattgaaacacaggattcatctgttcttgcacagttggggtggcctgatatgcgtttgccaatcctctatacattatcatggcctgacaggatttattgttctgaagacacttggccctgccttgatctttgcaagattggttcacttacatttaaaactccagataatgtaaagtatccatccatgaatcttgcctatgctgctggccgtgctggaggcacaatgacaggagttcttagtgcagcaaatgagaaagctgtagagatgtttattgatgaaaagattagctatttggatatattcaaagttgtggagctaacatgtgagaagcatcaaaatgaattgttatcctctccttcccttgaggaaatcattcactatgacctgtgggcgcgagaatttgctgctagtttgcaagactcttccagcttcactcctattcttgcatgaggatatgattaaactagggatgtggctgctggtgcttcccaattgcctgctttcaccataatttcttcaggcaattgaacaatttagaatgatgcattccctcagatgttgaaaaataaatagttttttttttttttgtttatggaatgttggtgttttaacacctttcaattgatcttataggtttgtcgtaatttcattgaaaacaatgtctttttaatagtgaataggagcctaggaggttggttgcctatgaatgtgtcaaagtcaagaaggggggtggatgttctcatgttcaaaatttacatgacgtggtcaactagaagttttgtatttcgctttttataataggattgaataagtgagtcttataaaacttaatagagatagataaaaaagttgaccaatcatc

SEQ ID NO: 9278 - DNA, 760 bp, Glycine max
cttatgttgttttgtgtgacagacaacagaggaacactcccaaacaaaccatggacgtgggtcagatgcagagacagtggatcgactacaccaaatccctcttcctcgagggcttcctggatggtcagtttctgcaacttcagcagcttcaagatgagaacaaccctgactttgtggtcgaagttgtctctctcttctttgaagattctgaaaggcttctcaaagatctcacctttgccctagatcagaatggcgttgacttcaaaaaagttgatgctcatgtgcaccagttaaagggtagcagttcaagcataggtgcacaaagggtgaaaaatgcctgcattgctttccgcaacttctgtgaggagcagaacacagatgcgtgcgtcagatgtctgcaacaagtgaaacaagagtactgccttgtcaagaataagcttgaaacaatgttcaggcttgagcaacagattgtggcagctggtgggtcaatccctacggaactgagtttcagtggatgatgggtgggtttgtagagatgcttgtattatgatcctcttctttgttaaagattatcctttatcttatttagtccatggtgaatgtatgggtttttatgaagatagaagttttccatccaatgtacctttttcttcaccaaaaagctcttcataatttgtaatcttttgcatgctttactgaaggatgatagcagcaccattaattgaactttcctcttttatctctcttccaaacgaggaag

SEQ ID NO: 9279 - DNA, 1133 bp, Oryza sativa
gccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggttcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgctgatcctaccatggccaaatcgaccaagaaggaaccggctacccacaagagatacaacctcaagaagctaacctacgagcagaggaaggccagtctcgtcgaaagattgaatgctctcaactcctcagctggtgctgatgatgatgacgaggaagaggatgacgagtgagagagtagccttatcacagtagtttcatcttatgctgccaaacaaactccttatggcatttaagtttacctgtagtcttgcaatttgcaacaggcatttttgtttatgttctgcactctgctcaaagaacctatttctttcggtttttgattctcaaccttgagctatcggttatcttattt

SEQ ID NO: 9280 - DNA, 1239 bp, Oryza sativa
gcctcctaacccggagcctctcgttaccgagagagagagagagagagagagagagggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccattaggagcgtcagtgaccatggtgacaccaaggagcttctgcaacttctacttccagttctgaaggtcaatggcatcgacttctacatcaatgggcacgaccactgcctggaacacattagcagcagagacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctact

SEQ ID NO: 9281 - DNA, 999 bp, Oryza sativa
gaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaacc

SEQ ID NO: 9282 - DNA, 2189 bp, Oryza sativa
ttggtttagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcttatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcgagatgtacattgtaagtatcagaaatcatgtgttactggtttttttgccataatatatgcctatataagccggg

SEQ ID NO: 9283 - DNA, 2129 bp, Oryza sativa
cacgcgcctcctctctcgcgcggctttccatttccatctccccctcctcctcctacgtctccgccgctcctcacttcctccactcgatttcctttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccagacactcggactgtcgcatgctcttacttcattcatgtggctctgtggtcctattgctggcatggtggttcaaccatgcgtgggtctatacagtgataggtgcacctcaaaatggggaagacgaaggccatatattcttacaggatgtgtgttgatatgcttggctgtcgtagttattggattttcagctgacattggatacgccatgggtgatacaaaggaagactgcagtgtctaccatggatcacggtggcatgctgctattgtatatgtcctgggattctggcttcttgatttttccaacaacactgtgcagggtccagcacgtgctctaatggctgatttatcaggacgtcatggacctggcacagctaactccatcttctgttcttggatggcaatgggaaacatcctaggatactcctctggttccacaaacaattggcacaagtggtttccattccttaaaacaagagcttgctgtgaagcttgtgcaaatttgaaaggtgcatttctggtggctgtgattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctggttgtcttggttcccattcatcctctacgacactgactggatgggccgtgagatctaccacggtgacccaaagggaactgatcctcagatcgaggctttcaaccagggtgtcagggcaggtgcatttggcctgctactgaattcgattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgttctgtacagtgttcccttcgcagtgacggcgcaattagcggccactagagggggtggccaagggctctgcaccggcgtcctcaacatctccatcgtcatccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttccggtcggtcagcatgggcggcggtcactgaccgccccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatcatc

SEQ ID NO: 9284 - DNA, 2208 bp, Oryza sativa
ggccgctgctgctctctcgctcttctccctccaataattcgcttgccctctggtggctcaaagcccagggaaattgatggagaagaattggggtagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcctatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcgagatgt

SEQ ID NO: 9285 - DNA, 2680 bp, Oryza sativa
ggcgacgaactcatcacctccactctctgctgcaacacgagtgaatcggaggcggcacgatgcgcaagtgggcgctctcctccgcgctcctcctcctcctcctcctcaccacactccccgatccagctaagaagctccaagtcaatgctgatgacagcactgatgagttagttgatccgccgaaggtagaggagaagattggtggtgttccccatggcctgtccacggactctgaggttgttcagagggaggctgagtcaatctcgaggaagaccctcaggagctcagcggagaaatttgagttccaggctgaggtgtccagactcatggacatcatcatcaactcactctacagcaacaaggacattttcctgagggagctcatctccaatgcttctgatgctttggacaagattaggttcctggctctcactgataaggaggttttgggcgaaggtgacactgctaagcttgaaatccagattaagctggataaggagaagaagattctctccattcgggataggggtattggtatgaccaaggaagatctcattaagaaccttgggaccattgccaaatctggaacttcagcttttgtggaaaagatgcagactgggggtgacctcaatctcattgggcaattcggtgttggtttctattcagtatacttggttgctgactatgttgaagtgatcagcaagcacaatgacgacaaacagcacgtctgggagtccaaagctgatggatcattcgctatctctgaggatacatggaatgaacccctgggccgtggaactgaaataagactgcacctccgagatgaagccaaggagtacgtggaagaagacaagctaaaggatttggtgaagaagtactctgagttcatcaatttccccatttacttgtgggcaaccaaggaggttgatgtggaagtgccagctgatgaggatgagtcaagtgaatcaagtgaagaagaggaatcatcccctgagtctacagaggaagaagagacagaagagagtgaagagaagaagcccaagacaaagacagtaaaggaaaccactactgagtgggagcttctgaatgatgtgaaggctatatggcttcgtagccctaaggaggttactgaagaagaatacacaaagttttaccactcacttgctaaggactttggtgatgacaagcccttgtcttggagccacttcactgctgagggagatgttgagttcaaagctttgctctttgttcctcccaaggctccacatgatctctatgagagttactacaactctaacaagtcaaaccttaagttgtatgttagaagggttttcatctctgatgaatttgatgagcttcttccgaagtatctcagctttttgaagggtctcgtcgactcggacacattgcctctcaatgtatcacgagaaatgctccaacaacatagcagcctgaagaccatcaagaagaaactaatccgcaaagctcttgacatgattagaaaacttgctgaggaagatcctgatgagtacagcaacaaagataagacagatgaagaaaaaagtgcaatggaggagaaaaagggccagtatgccaagttctggaatgagtttggaaaatcagtcaagttgggcatcattgaagacgcaactaacaggaaccgtcttgcaaagcttctgagatttgaaagtaccaagtcggaaggcaaacttgcctctcttgatgagtacatttcaaggatgaagccagggcagaaggacatcttttacattaccggaagcagcaaggaacaattagagaaatcaccgttccttgagaggctaaccaaaaagaactacgaggttatctacttcactgaccctgttgacgagtacttgatgcaatacctcatggactacgaggacaagaagttccagaacgtctccaaggagggtctcaaactcggcaaggactctaagctcaaggacctcaaggagtccttcaaggagctgaccgactggtggaagaaggctcttgacaccgagagcgtggactcggtgaagatcagcaaccggctgagcgacaccccctgcgtggtggtgacatccaagtacgggtggagcgccaacatggagaagatcatgcagtcacagaccctctcggatgccagcaagcaggcgtacatgcgcggcaagagggtactcgagatcaaccccaggcaccccatcatcaaggaactccgtgacaaggtcgcccaggacagcgagagcgagagcttgaagcagacggcgaagctggtgtaccagacggccctcatggagagcggcttcaaccttcctgatcccaaggacttcgcctccagcatctacaggtcggtgcagaagagccttgacctgagccccgacgcggccgtggaagaggaagaggaggtcgaggaggccgaggttgaagagaaggaatcatccaacatcaaggaggaggcggagccgtcgtcgtatgataaggacgagctgtagtgatgtgtcgccaccaactgttgtttttttatctagctcttgtgttaggttgtttaaaaatgtgatggtttcgagggacgtccatttttccatgcgaaaatgcttagtaccatgatacggggattttgtcgatgtacgtagtttgtgatactctagttcaaattaatggccgtctaatttcgatc

SEQ ID NO: 9286 - DNA, 1849 bp, Oryza sativa
cccaagctaatccccctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttctcaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctct

SEQ ID NO: 9287 - DNA, 877 bp, Oryza sativa
cgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaagagaatggcggtgtcaaggcagtagcagcagttgcagctgatcagcttgtgctccagctggaaggtgacaccggcaatggcgacgaggtctccgagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccaactacacgctgaaatccaaagctaatacaaggaagatcgagatcgagataaattaaccaactctatatgcatatctatctatccatctacctctgcatgctgttttcactgcatcgatcgctactgttctgcagtgccaatcactgtccgtttctgtacaatctgtgatactactagctagtagcagtacatggcatcgttttccttcaagtgttcgttggcttttacttagtccggtgagtgcttgtgggttatttctgacgagggagtgtgatcagtacgcgtactaatggtattttggtttgtcatggcatgatgaaattaagctgtggtagcaatataatgcatatatatattacctttgtctcatgtccttagtatgtagtagtggtaaatagtacatagcatgaataatatacttatcaaggaacacttgtgttttgtttaatggcgc

SEQ ID NO: 9288 - DNA, 1699 bp, Oryza sativa
tgatcctccattgctgcaaaagaagaagaggtagacgaaggaggaggagatcaggtgatcatggggactcaggtggcagataactacccaccggccaaggatggccggagcgcgcaggagaaggcgatcgacgactggcttcccatcacgtcgtccaggaacgccaagtggtggtactccgccttccacaatgtcaccgccatggtcggcgccggcgtcctcagcctcccctacgccatgtccgagctcggctggggacctggcatcgcggtgctgatcctgtcatggatcatcacgctctacacgctgtggcagatggtggagatgcacgagatggtgcccgggaagcggttcgacaggtaccacgagctcgggcagcacgcgttcggcgagaagctgggcctctggatcgtggtgccgcagcagctcgtcgtcgaggtcggcgtcaacatcgtgtacatggtcaccggcggcaagtcgctgaagaagttccacgacgtgctctgcgagggccacggctgcaagaacatcaagctcacctacttcatcatgatcttcgcctccgtccacttcgtcctctcgcagctcccaaacttcaactccatctccggcgtgtccctcgccgccgccgtcatgtcgctcagctactccaccatcgcgtggggcgcgtcgtggacaaggggaaggtggccgacgtcgactaccacctgcgcgccacgacgtcgacggggaaggtgttcggcttcttcagcgcgctgggcgacgtcgcgttcgcgtacgcggggcacaacgtggtgctggagatccaggcgaccatcccgtcgacgccggagaagccgtccaagaagccgatgtggaagggcgtcgtcgtcgcctacatcatcgtcgcgctctgctacttccccgtggcgctcgtcggatactgggcgttcggcaaccacgtcgacgacaacatcctcatcacgctctccaggcccaaatggctcatcgcgctcgcaaacatgatggtcgtcatccatgtcatcgggagctaccagatctacgccatgccggtgttcgacatgatcgagaccgtgctcgtcaagaagctcagattccctcccggcctcacgcttcgcctcatcgcaagaacactctacgttgcgttcaccatgttcatcgcgatcaccttcccgttcttcggtggattgcttgggttcttcggtggattcgccttcgcgccaactacttacttccttccctgcatcatgtggctagcaatctacaagccaagaaggttcagtctctcatggttcaccaactggatctgcatcattcttggagtgatgctcatgatcctgtcaccaatcggaggactccggcagatcatcatagatgccaagacatacaagttctactcgtagattacatgttcatcatagtaatctcatgtggctgcaagttcaagttctactcataggcacacatgatgaaaccagttactgcaaaagttttttttttagccaacaaaggaagaagaaagttcaacaccaagttcatacattgtcactacgacgatgatcttttgagacgtgtcatgcatgcatcagtcgttaattatgtgacttaattaaaaacaaagaggttgtgtttgtgcattgtcgctgggttaatcatactgtgtttttatatttcaatctactattatattgtaggctgg

SEQ ID NO: 9289 - DNA, 2263 bp, Oryza sativa
gccgtgcggggaaacaagtaaacgctcgctcgctgcgtctccgatgcccccgtccccgcctggccgctgctgctctctcgctcttctccctccaataattcgcttgccctctggtggctcaaagcccagggaaattgatggagaagaattggggtagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcctatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcg

SEQ ID NO: 9290 - DNA, 825 bp, Oryza sativa
ctccaaatcgccacgcaggaagggaggaaaggaccaccagccaccgcgcgcgcccaaatcgtcgcagctgcttccccgaggagaagaacatgagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgatgacaccccttatgagcttgatcttgagctctttgatgctgtgaatgttgaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcttggtgacttcggtgatatggacttctcgaagctgggcatgggaggtcctgatgatgatcttgaggacgatgacgaagatgacacggctgacagtgctaacaaagatgatgaagacattaaggcagaggggagcggggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtaattatggtttagtagctccattttgttaaaaaactttgtgcattgcacactgttctgttatgtgaatcgccatatttgcatcaaccattgcaaagctatccagcc

SEQ ID NO: 9291 - DNA, 1149 bp, Oryza sativa
gccttccccccccccattcgtcgcctcctgtcccgggggccgcgagcaaaacccccacccccaaatcgcagcctcgctcagctcgatctctctctcgtctcgccatggcccccagcgacgacctcgtctacatggccaagctcgccgagcaggccgagcgatacgacgagatggtggaggcaatgaatagtgtggcaaagttagacgaggggctgacaaaggaggagaggaacctcctctcagttggctacaagaatttgattggtgcaaagcgtgcggcaatgcgtatcattggatccattgagctaaaggaggagacaaagggcaaggagagtcatgtaaggcagactgctgagtatcgtcgcaaggtggaggctgagatggataaaatctgctgtgatgtcataaacattattgacaagtaccttatcccacattcctctggagctgagagctcagtcttctactacaaaatgaagggagattactaccggtaccttgcagagttcaagactgggactgagaagattgaagtgtctgaactgtcactcaatgcttatgagactgcttccaaaactgcgcagacagatctcactccaactgaccctatcagacttggtttagctctgaatatatctgtcttctactgtgagatcatgaactcacctgacaaagcttgccaacttgctaagaacgcctttgatgaagctgttgcggagcttccctccctcagtgaggagaattacaaagatagtacactgatcatgcaacttctgagggataatctagcactgtggaattctgatatggctgatgatgcagacgatattagggaacgaacagatacaactggtgctaaaggtgaccctgcagcgtgatggaggtgctaatagctggtagagtcgaagcataacaacaacaacaacaagggtgtggtggggtgcggaaggactaccatttactcactgttagtgttaggttctgtagtgtaggagttgagctgctgagtaaccctcgcttgtagtctgggcctgattcttcgacttcttgagcaacatcgtgtactaagcactcgctgatcgctcttttgcaagcattgtttttttttgggttactcttgatgatgattaggcaaaagttatctggttc

SEQ ID NO: 9292 - DNA, 2000 bp, Oryza sativa
cactcctctcccctccccacgcaaccgccttcctccgccgccgccgacgccgacgccgacgccgaccccttctcccaatctgcggattccagcgggggtcccccccccctcccaccggcggcgcccggtggtcgtggtcgtgggggaggggagtcaacgaacgagccgagccgcccgcttgccggagctctctatctatctctctatctctatctctatccctccagattccctcctccatcgaatctctgatatttggagggagcgactcgacgcagcatcgcatcgtaaggaaggtcccctccactgtcgatggatcagcaccagctcgacgaggagaaccagagagccgcgctcttccactcctctgccccatcttcctctttgggagctgacggggaggaggagagggagactgtgccgctgctgtcctgcaagatggccgacgataaatctgacactgtccaggtctccgaggatacggcgcaccagattagcattgatccctggtatcaagttggattcattctgacaaccggggtgaatagtgcatatgttctgggatattctgcatcaatcatggtccctttaggctggattggtgggacatgtggcttgattctagctgctgcaatatccatgtatgcaaatgctcttcttgctcaccttcatgaagttggtggcaaacgccatatcagatacagagatcttgctgggcacatatatggtagaaaaatgtattcgcttacatgggctctgcaatatgttaatctattcatgatcaacactggccttatcattttagctggtcaagccctgaaggcaatatatgtattatttagggacgatggagttctaaagctaccctactgcatagcattatctgggtttgtctgtgctctttttgcctttggaatcccttatctgtctgctctcaggatttggttgggattatcaacagttttcagtctcatctatataatgatagcatttgtcatgtcgcttagagatgggattaccacacctgcaaaggattatactattcctggatcacattcagatagaatcttcactacgataggtgctgtagcaaaccttgtgttcgcttacaacactggaatgctcccagaaattcaagcaaccataaggcctcctgtggtcaagaatatggagaaggctctatggttccagttcactgttggttcgttgcctctttatgctgtcacctttatggggtattgggcgtacgggtcctcaacatcaagctatctactgaatagtgtgaagggaccaatttggataaaaactgtggcaaatttatcggcgtttcttcagactgtcatagcattacatatatttgcaagcccaatgtacgaattcttggacacaagattcggcagtggacatggtggtccttttgcaatccacaacataatgttcagagtgggtgtcagaggaggctacctgaccgtcaacaccttggtggccgcgatgctccccttccttggcgacttcatgagcctgacgggtgcactcagcacctttcccctgacattcgttcttgcaaatcacatgtacctcacggtgaagcagaacaagatgtccatcttcaggaaatgctggcactggctgaacgttgttggcttcagctgcttgtccgtcgcagctgcggttgctgcggtgaggctaatcacggtcgactacagtacataccatttgtttgctgatatgtgaggctggaaagtgcaagcatgcagccctggatcagctgtaaattcgtcctcttcttttttatttttttggttaggggatgcatgtaggtcgatagaatgatggagattgcaataaataatttggctaaaatgttgtccagatttggttgtttgaggtgcaagatgtttgcctcaaaacgtaccgctatggttcactttttaagaactgtactgctacctctgtttgcggagatttttgtctgcaggcatgcaggatgaatattattc

SEQ ID NO: 9293 - DNA, 1691 bp, Oryza sativa
ttcgctctcgtccccttccctctcctctctcgctcgctcctcttccgcggcgcgcgcgccggcgactcgccgcgtcgggccggccgacaaccgccgcgagggagaagccccctccccttggggggcacccatgacgtcgtgcgggtgcctggtgctcgagaaggtggaggaccacggcggcgaggcggcggggagggggagagggaggctcgcgcagggtggcggcggcggcggcggtggctgcggatcgtgcgcgggggagtggaggagccggtcggagaccatgttccccatctacgtgatggggagctcgcgggccagctccgccgcggcggcgcggggcatagtcgacgccgccggggaccccatatgggaggccgtcaagtcggaggccaagtctgaggcagagaaggaacctattttaagtagcttcttgtacgccagcgtactatctcatgactgtctcgagagggcgttgagtttcgtccttgcaaacaggctcgaagatccaacattgcttgcaactcagttaatagacattttcaatgatgttatgatgaacaacaaagatatacgccgttctattcgccttgatgctcaggcctttaaagacagagatcctgcctgtgcacaatacagttgggcattgttgtacctcaagggttaccattccgtgcaatcctataggatagctcatgtattatggaatcaaggtcgtaaagttctggcattggcactgcagagccgtatcagtgaggtttttgcagtggatatacacccagcggccagaattggagagggaatattgttggatcatggaacgggtctagttattggtgaaactgccattgttggaaactgggtttcattaatgcagggtgttacacttggtggtactggcaaggaaaatggagatagacaccccaagattggtcagggggctcttcttggagctggtgctactatcctcggcaacataaacgtaggcgaaggtgccatgattgctgctggttcccttgttttaaaggatgtacctccccacagtatggcagtaggaaaccctgcaaaggtagttgggtataaagataaggaagacccttctttaactatgaaacatgatgccagaagagattattttgagcatgttgccgttagtttttcagatgacaaagctaatggaagtgttgtgaagtaaaaaaaggttcgatgatgtttggctggcagttcaaaggaatagcatatgtttcgacatttcttcccagaggacagcactgggtatctgattatgcaagggtgcttctcttttttgcccaggtacccatggtcctgaagctccccagttatattttctcgtggcctttggaccgctgtaataatgtgatgtttatttttctggttactttgtaaggactatgtactggtagtggagaccagtacatagttgctactggtagtagagaccagcagcaactatgtacttcagaatacaagctttcttttttgaatcccagtagcatcagcgtagtgcttaagacttagtgcaagctttcttttctgaatcagtagcgtgaagtatattctacagtactagcctattaggtaaagatgtttttcttttgatgtactaacccatcagaaaaaaaatgttacatctggatgggataataaaaaaggaggcaattgttaaattc

SEQ ID NO: 9294 - DNA, 1182 bp, Oryza sativa
caacccacgcctccctcgcatcgcccctccccgaccccgccgagatcggagcaggcgccgcctccctcctcccgcctcctcctccgccatggcgccgtctctgctcggggggttcaccaagtcgctggccatgacggtgctctcggagatcggcgacaagaccttcttcgccgccgcgattctggccatgcgctatccccggaagcttgttcttgctggttgtctcacctcattaacagtgatgacggctctatcagtttcacttggttgggttgcgccaaatctgatatcacgcaaatggactcatcatgtgaccactctgctattctttgtgtttggcattttgtcattgtgggaaggcttcaaagaagatggagattcagaagaattggctgaagtggaagctgagctggatgctaattttaaaagcaacaaagcagaatcgaaaagtaaatctaaggcaaatgatgataaaaagaagcagcaaagaccatttgttttgcagttcttctcaccaatctttataaaggcattttccattacattctttggagagtggggtgataagagtcaaattgctactattggtttggctgctgatgaaaatccattcggtgttgtcctggggggagttctggcccaagcactctgcactaccgctgctgttatgggtgggaaaagcttggcctctcaaatatctgagaaaatggtcggattgtcgagtggagtgctattcctgctgtttggtatcatgtcatacttgtcaggaccagaaggagaattataatgcccccagaaagtcatgcataaggagaattatcatgttcatcatggccggttaacaagcttgttttcactacgacttgatctcatcttagtaggtggacgatggcgacgaaagcgctgatcctttgcaaggaggatggcgattacttagcttagtcaacacattgtaaacatttcactcatcattcataaataacaagatggtaccaaagactctactggttgcttcgtgttagtcccagcaccagacaacattcagccaaaactgtcggagtagttgctgcatactaccatactatttttttggtcgcaactatgcataagaactgctagtcttcggactaaattgcctggactgaagaggggttacaaatcataaaaagtgatttcagaatt

SEQ ID NO: 9295 - DNA, 1158 bp, Oryza sativa; identical to SEQ ID NO: 3502

SEQ ID NO: 9296 - DNA, 1132 bp, Oryza sativa
cacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcggttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagcctt

SEQ ID NO: 9297 - DNA, 1186 bp, Oryza sativa
cttcgttcgctcatcgcgtctcgactccactactgtggttgcatatactactacacttgcagttgcatccagagcccgccccgcgtctctactcgctccgccgcgccgtcgtctctcccgacttcggcgacaagcgagcgacgcaggccaccgcgcgcggttcgttttcgcgagggaggccgccgccgaccagccgccatggtctcgccggacaccatccgcacggccatcggcgtcgtaggcaatggaaccgccctcgtgctcttcctctccccagtgccgacgttcatacggatctggaagaaggggtcggtggagcagtactcggcggtgccgtacgtggcgacgctgctcaactgcatgatgtgggtgctgtacggcctccccgcggtgcacccgcacagcatgctggtcatcaccatcaacggcaccggcatggccatcgagctcacctacatcgccctcttcctcgccttctccctcggcgccgtccgccgccgcgtcctcctcctcctcgccgccgaggtcgccttcgtcgccgccgtcgccgccctcgtcctcaacctcgcccacacccacgagcgacgctccatgatcgtcggtatcctctgcgtcctcttcggcaccggcatgtacgccgcccccctctccgtcatgaaaatggtgatccagactaagagcgtggagtacatgccccttttcttgtccctggcgtcactggtcaacggcatctgctggactgcctacgccctcatccgcttcgacctctacatcacgatccccaacgggctgggagtgatgttcgcggtggcgcagctgatcctgtacgccatctactacaagtcgacgcagcagatcatcgaggcgcgcaagcgcaaggaggccgaccatgtcgccatgaccgatgtcgtcgtcgactccgccaagaacaacccctcctccggcgccgccgccgccgccgccaacggccgctactagctcacgccgccctctttacttcaccagctagccagtcactcaggaggcatggccaccgatgaggccttcatgacttactagcaaagtggagtactacctttagctaagccgtcccaaagggatattactacatgtctcaaattaattagctaatctaatcaccatcaccctgcctaatccgctgctgttaattagtatggcagagagc

SEQ ID NO: 9298 - DNA, 1630 bp, Oryza sativa
agagagggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccattaggagcgtcagtgaccatggtgacaccaaggagcttctgcaacttctacttccagttctgaaggtcaatggcatcgacttctacatcaatgggcacgaccactgcctggaacacattagcagcagagacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctactaaagaaatttgagacaaggccgagaccatcctactagactaggaaaagagatgttcagtatggtatccattagatctgattcatacaacttcttgccagaggaccatcgattatgccatgtataatttacaaagaaggcttaaaactctaaaagctagtagtgacctttgcatatcggcatcagggttcttcagtattgccaagcattcacatataacctttggagagagagagagagagagagagactttgggggtttctaagctggtattttcatttaaaagagacaatgaaaagaaaatttgatctatgataatcaagcatgtgtcggtgaagacggctattagttactgcttctggaaaaaggttgtaattcagtacagagttgtgtacgtgtccatttgaataaaaattgcatataacagaataaaattataatg

SEQ ID NO: 9299 - DNA, 2685 bp, Oryza sativa
ggcgaggcgacgaactcatcacctccactctctgctgcaacacgagtgaatcggaggcggcacgatgcgcaagtgggcgctctcctccgcgctcctcctcctcctcctcctcaccacactccccgatccagctaagaagctccaagtcaatgctgatgacagcactgatgagttagttgatccgccgaaggtagaggagaagattggtggtgttccccatggcctgtccacggactctgaggttgttcagagggaggctgagtcaatctcgaggaagaccctcaggagctcagcggagaaatttgagttccaggctgaggtgtccagactcatggacatcatcatcaactcactctacagcaacaaggacattttcctgagggagctcatctccaatgcttctgatgctttggacaagattaggttcctggctctcactgataaggaggttttgggcgaaggtgacactgctaagcttgaaatccagattaagctggataaggagaagaagattctctccattcgggataggggtattggtatgaccaaggaagatctcattaagaaccttgggaccattgccaaatctggaacttcagcttttgtggaaaagatgcagactgggggtgacctcaatctcattgggcaattcggtgttggtttctattcagtatacttggttgctgactatgttgaagtgatcagcaagcacaatgacgacaaacagcacgtctgggagtccaaagctgatggatcattcgctatctctgaggatacatggaatgaacccctgggccgtggaactgaaataagactgcacctccgagatgaagccaaggagtacgtggaagaagacaagctaaaggatttggtgaagaagtactctgagttcatcaatttccccatttacttgtgggcaaccaaggaggttgatgtggaagtgccagctgatgaggatgagtcaagtgaatcaagtgaagaagaggaatcatcccctgagtctacagaggaagaagagacagaagagagtgaagagaagaagcccaagacaaagacagtaaaggaaaccactactgagtgggagcttctgaatgatgtgaaggctatatggcttcgtagccctaaggaggttactgaagaagaatacacaaagttttaccactcacttgctaaggactttggtgatgacaagcccttgtcttggagccacttcactgctgagggagatgttgagttcaaagctttgctctttgttcctcccaaggctccacatgatctctatgagagttactacaactctaacaagtcaaaccttaagttgtatgttagaagggttttcatctctgatgaatttgatgagcttcttccgaagtatctcagctttttgaagggtctcgtcgactcggacacattgcctctcaatgtatcacgagaaatgctccaacaacatagcagcctgaagaccatcaagaagaaactaatccgcaaagctcttgacatgattagaaaacttgctgaggaagatcctgatgagtacagcaacaaagataagacagatgaagaaaaaagtgcaatggaggagaaaaagggccagtatgccaagttctggaatgagtttggaaaatcagtcaagttgggcatcattgaagacgcaactaacaggaaccgtcttgcaaagcttctgagatttgaaagtaccaagtcggaaggcaaacttgcctctcttgatgagtacatttcaaggatgaagccagggcagaaggacatcttttacattaccggaagcagcaaggaacaattagagaaatcaccgttccttgagaggctaaccaaaaagaactacgaggttatctacttcactgaccctgttgacgagtacttgatgcaatacctcatggactacgaggacaagaagttccagaacgtctccaaggagggtctcaaactcggcaaggactctaagctcaaggacctcaaggagtccttcaaggagctgaccgactggtggaagaaggctcttgacaccgagagcgtggactcggtgaagatcagcaaccggctgagcgacaccccctgcgtggtggtgacatccaagtacgggtggagcgccaacatggagaagatcatgcagtcacagaccctctcggatgccagcaagcaggcgtacatgcgcggcaagagggtactcgagatcaaccccaggcaccccatcatcaaggaactccgtgacaaggtcgcccaggacagcgagagcgagagcttgaagcagacggcgaagctggtgtaccagacggccctcatggagagcggcttcaaccttcctgatcccaaggacttcgcctccagcatctacaggtcggtgcagaagagccttgacctgagccccgacgcggccgtggaagaggaagaggaggtcgaggaggccgaggttgaagagaaggaatcatccaacatcaaggaggaggcggagccgtcgtcgtatgataaggacgagctgtagtgatgtgtcgccaccaactgttgtttttttatctagctcttgtgttaggttgtttaaaaatgtgatggtttcgagggacgtccatttttccatgcgaaaatgcttagtaccatgatacggggattttgtcgatgtacgtagtttgtgatactctagttcaaattaatggccgtctaatttcgatc

SEQ ID NO: 9300 - DNA, 1050 bp, Oryza sativa
gccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgccggcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtcc

SEQ ID NO: 9301 - DNA, 1549 bp, Oryza sativa
gcgtcgagctgcctagctatcgagatcttcgtacgtaaatacgtctccctcgtctccggcgagccaccggcttgggcgtacgtgagagatggcgccgccgtcagccatgaacacgtcgagggcggaggagaaggccatcgacgactggctccccatcacctcctcccgcaacgccaagtggtggtactccgctttccacaacgtcaccgccatggtcggcgccggcgtcctcagcctccccttcgccatgtccgagctcggctggggtcctggggtggcggcgatgatcatgtcgtgggtgatcacgctgtacacgctgtggcagatggtggagatgcacgagtgcgtgccggggcggcggttcgaccggtaccacgagctcgggcagcacgcgttcggggacaagctggggctgtggatcgtggtgccgcagcagctcatcgtcgaggtcggcgtctgcatcgtctacatggtcaccggcggcaagtcgctcaagaagttccacgacctcgtcgcgccgccctccgcgccgcccatccggacctcctacttcatcgtcatcttcggctgcctccacctcgtcctctcccagctccccaacttcaactccatcaccggcgtctccctcgccgccgccgtcatgtcgctcagctactccaccatcgcctgggccgcctcgctccaccaccacaaccacaacaatggcgccgccgccggaggcgtggactactcgctgacggcggcgacgccggcggggaggacgttcaacttcctgagcgcgctgggggacgtggcgttcgcgtacgcggggcacaacgtggtgctggagatccaggcaacgatcccgtcgacgccggagcggccgtccaaggggccgatgtggcgcggcgtcgtgctggcctacggcgtggtggccgtctgctacctccccgtggcgttcgcggggtactacgtgttcggcaacgccgtggacgacaacgtgctcatcacgctggagcggccggcgtggctgatcgccgccgccaacatattcgtcgtcgtgcacgtcgtcggcagctaccagatctacgccatgccggtgttcgacatgctcgagaccttcctcgtcaagaagctccgcttcaaacccggcatgcctctccgcctcatcgcccgatcactctacgtcttgttcaccatgttcgttgccatcgccgtccctttctttggtggattgctaggcttctttggtggctttgcgtttgctccaacgacctacttcttgccatgcattatgtggctgtcgatcatgaagccaaagaggtttggcttgtcctggtgcatcaactggttctgcatcatcatcggcgttcttctgtcggtgttcgcaccaatcggaggtctccgctcgatcatcgtgaatgcccagagttacaagttcttctcgtgagtgattaattgagaggtgttttaccattcaattaagtgtgttcttaattaattaggggattgttttagataatgcacagagttctatttaattagatgaaagagaaattcgtgtgtccct

SEQ ID NO: 9302 - DNA, 949 bp, Oryza sativa
tcggcgtgtagaggtgatcggaggcgagcgcaccggagcacaccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgcttt

SEQ ID NO: 9303 - DNA, 677 bp, Oryza sativa
gcggaaatatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 9304 - DNA, 1749 bp, Oryza sativa
caagccaccccgacacgaatcgctcaggcctcccccctgttgttcatccctcactcaacttttgggcagcttggctttattcaattccccttcctttttattgcgaatttgcgactgcgagcgagcttttcttcctcaaaggaagacgacgacggaggagcagccctgcagagcataaagagaggagaggagaggagagggggccggtcaaggaagaggagggaagatgagcagcacagctccactcctcacaccctacaagatgggaagatttgatctttcccacagggtagttctcgcaccactgacaaggcagcgatcctatggtaatgttcctcagcctcatgccattctgtactatcagcagagaacaaccaaaggaggccttttgattgctgaggccactggaatctcggacactgctcaagggtacaaagatactcctggtatttggacaaaggagcaagtggaagcgtggaagccaatcgtagacggcgttcatgccaaaggaggaatatttttctgtcagatttggcacgtaggaagagtctctaataacacttttcagcctaatgggcaggctccaatttcgagcaccaataagtcactaaaacctgcagtaagagccaacggcatagatgtggctactttctcaactcctaggcgattagagactgatgagatcccttttgtcgtgaatgattacagggttgctgctagaaatgcaattgaagcaggatttgatggtgttgaaatccatggagctcatggttatttgatcgatcagtttctaaaagaccaagtcaatgatcgttctgacaaatatggtgggagcttagagaatcgctgccggtttgcgctagaagtggtccaagccgtaactgatgaaattggagctgacaaggttgggataaggctgtcaccctttgccagctattcagaggcagcagactcaaacccagaagctctaggcctatacatggcaaatgcactaaacaagtttggtatcctctattgtcacatggtggagccacggatggtaaagcttggtgaaaagtttgaaaccccccatagtcttcgtccaatcagggatgctttcaagggaacgtttattgctgctggtggctacaataaggaggatggaaataaagcagtctccactggatatactgatttggttgcttatgggcgcttgtttttgtctaatcctgatttgcctgagaggtttgaaatagatgctcctctcaacaaatacaacagagagactttctacatctctgatccagttattggatacactgactacccatttcttccatcagatgtctaaatgtgcctttcagtactcgaattctcttccgcctctcatcaaagcagctcagcagccaccatttgtgttgttacttggtaggattgaagaaatatggccattgatctgaaagctgtttttcatgtgtgtgggcaaagcattgataaaataatgtgacattgtgatttcagcacggcacatgaatacaaagggagatgataggtagatcaagcagtgttgagaaattattttagtttgtatgcacaaatattgtgagcctgatataatatcagggagcttgcctgtcttactttgctctcaaatatgttctcagtcattcacatggttgtcagcgactgcaaatcttttacgtattcctgatatgtgtcactgactgagagatgggagtacagttggaataaaaagtggaagttgaatgt

SEQ ID NO: 9305 - DNA, 2409 bp, Oryza sativa
cgcagccgcagccgcagccgcgcgtcgtctcctccgcccgcgagctcctcttcccgccggcgagagatcaggagcacgcaaggcgcgcggccatggcgtcggagaccgagacgttcgccttccaggccgagatcaaccagctgctgtccctcatcatcaacaccttctactccaacaaggagatcttcctccgcgagctcatctccaactcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgcttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatact

SEQ ID NO: 9306 - DNA, 1502 bp, Oryza sativa
cgcaaaccgcatcgatcaactccttccccaagtcgaagcaaaatccctagcgatgtcgtcgccgccgcccgccgccgccgccgcgatggccgtcgacgacgccgacgacgaccagctcgcctccatgtccacggaggacatcgtcagggcaacccgcctcctcgacaacgagacccgcgtcctcaaggatgagctgcagcggacgaaccttgaggtggaatcctacaaggagaagatcaaggagaaccaggagaagatcaaactcaacaagcagctgccttaccttgtcggcaacatcgtcgagatattggaaatgaaccccgaggatgaggctgaagaggatggtgcgaacatcgatctggattcacaaaggaaaggaaaatgcgttgttttgaagacatccacaagacaaataatattccttcctgtaatcgggcttgttgaccctgaaaagctcaagcctggggatttggttggagtcaacaaagacagctacttgatactagacacgctaccttcagaatatgattcacgggttaaggcaatggaggtagatgaaaagcctacagaggattacaatgacattggtggccttgagaaacagattcaagagcttgttgaagcaatagtattgcccatgactcacaaggaccggtttcagaagttgggaattcgccccccgaaaggtgttcttttgtacggaccacctggcactggaaagaccctaatggctcgtgcatgtgctgcccaaactaacgccacatttctgaaacttgctggtccacagcttgtccagatgttcatcggtgatggtgcaaagcttgtccgtgatgcctttcagcttgcaaaggagaaatccccctgcatcatttttattgatgaaattgacgcaattggaacaaagcgttttgatagtgaagttagtggtgacagagaagtgcagcgcacaatgttggagttgctgaatcagctagatggattcagtagtgacgagaggataaaggtgatagctgcaactaatcgcgcggacattcttgatcctgctttgatgaggtctggtaggctggaccgaaaaattgagttccctcatccatccgaagaagcacgagctagaattttgcaaatccattcaagaaaaatgaatgtaaaccctgatgtcaactttgaagagttggcacgatctacggacgacttcaatggtgcacaactgaaggccgtttgtgtagaagcaggcatgcttgccctacgccgagatgctacagaggtgacacacgaggatttcaatgaagggatcatacaagtgcaagccaaaaagaagtccagtttaaattattacgcttaattcttccgagagagttattaggcctaaggaaacgctccgtccaaaattgtttgtttgtaacactaccgttttatatatttgtgtggttcaagatgtgattgtacgaaacatgtcttgcgctgttccttctctgcttgatatatactgatagaagttgact

SEQ ID NO: 9307 - DNA, 1230 bp, Oryza sativa
gcttctccaattttccaagcctgcctccaagcgcacgccacgatcttctagaagcgattcgcgcgcgccgccgcctcctcccctccccttccccggagcgaagccgccccgccgggggggatgtcgccggcggcggacagcgcggcgtcgaagcggcaggcggagctgctcaagcaggagggcaacgccttcttcaagaaggaccgcatcagcgccgccatcgacgcctacaccggggccatagctctctgcccaaaggttgcagtatattggaccaaccgagcactttgctacaagaggcggaatgagtgggttagggctgaggaagattgtagaacagctattcagcttgacagccactctgttaaggcacattacatgctcgggcttgcacttctcaacaaggacgaattggccgagggaataaaagaactagagaagtcgttggagcttggaaggggtgcacatccagcaagttacatggttgaagagatctggcaagagctttctaaagcaaaatacatagaatgggaaaatttatcaagcgaacgagtccgtcaattgcataagctgaaggaagcatgtaaagaagctcttaggaattataacagccttgacaatcctcctgcatatgtccccgaggaacagctaaatgagcttgaggaagtttttcggaatgccaggaagtctgatattccaacagaagttcctgatcatctctgctgcaaaattactcttgatattttcagagacccggtgataaccccaagtggaatcacgtatgagagggcggtgattcttgatcatcttcatagggtggggaagtttgatcctgtgacccgtgagacacttgaaccacaccaactggttcctaaccttgccatcaaggaagctgtccatgcatttttgagtgaacatggttgggcttacaggatgagatgactactttgaattacacctgggcttggagctttggaggcaacatttcagattgcaatatacatgtttcggttagtcaacttaaatgtgtcattttgtttatctttacatatttattggtggaaaaggttttacctgggatggctgtgtacagattccccttctctagctatccctcctctctactctgttcatgtgtaatgcttggtatcagattatcacttatccacagtaaaagaaaattaaagtggctgtcatactccttgttctctgattattggtttttggcgc

SEQ ID NO: 9308 - DNA, 2152 bp, Oryza sativa
caccacctcctcctcctcctcccatccagcacgcgcctcctctctcgcgcggctttccatttccatctccccctcctcctcctacgtctccgccgctcctcacttcctccactcgatttcctttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcggcgcgcgtggtgggggaggcggtgaggcggcggcggcggtggagacggcggcgccgatcagcctcgggaggctcatcctctccgggatggtcgccggcggcgtgcagtacgggtgggcgctccagctctccctcctcaccccctacgtccagacactcggactgtcgcatgctcttacttcattcatgtggctctgtggtcctattgctggcatggtggttcaaccatgcgtgggtctatacagtgataggtgcacctcaaaatggggaagacgaaggccatatattcttacaggatgtgtgttgatatgcttggctgtcgtagttattggattttcagctgacattggatacgccatgggtgatacaaaggaagactgcagtgtctaccatggatcacggtggcatgctgctattgtatatgtcctgggattctggcttcttgatttttccaacaacactgtgcagggtccagcacgtgctctaatggctgatttatcaggacgtcatggacctggcacagctaactccatcttctgttcttggatggcaatgggaaacatcctaggatactcctctggttccacaaacaattggcacaagtggtttccattccttaaaacaagagcttgctgtgaagcttgtgcaaatttgaaaggtgcatttctggtggctgtgattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctggttgtcttggttcccattcatcctctacgacactgactggatgggccgtgagatctaccacggtgacccaaagggaactgatcctcagatcgaggctttcaaccagggtgtcagggcaggtgcatttggcctgctactgaattcgattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgttctgtacagtgttcccttcgcagtgacggcgcaattagcggccactagagggggtggccaagggctctgcaccggcgtcctcaacatctccatcgtcatccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttccggtcggtcagcatgggcggcggtcactgaccgccccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatc

SEQ ID NO: 9309 - DNA, 1494 bp, Oryza sativa
ctctagctaaataggttcgtacgtataggatatttgatccattgatcgatggccgtcgacatggagctcgacggcggtggcgacggcaagggcaaagccccgccgcagataagcctgtcggggctattccttgcgtgcatggtcgccggtggcgtgcagtacggctgggcgctgcagctctctctcctcaccccgtacgttcagacattgggaattcctcatgcactcacttcagttatgtggctctgtggccctattgctggcttaattgttcagccatgcgtcggcctgtacagtgacaagtgcacatccagccttggaagacgtagaccgttcatcctcactggatgcataatcatctgcatatctgtgatcgtcatcgggttctcctcggacatcggctacgctctcggcgacacgactgaggactgcaaggtttacaggggtcctcgttaccatgcagcggcggcattcatcctcggattctggctgctcgacttctccaacaacaccgtgcagggtccagctcgcgctctgatggccgatttgtcaggtcggcatggcccaagcgcggccaacgcgatcttctgttcttggatggcattaggcaacatccttggctactcctccggatccaccaatgactggcacaagtggtttccctttctcatgaccagggcttgctgcgaggcctgcgcgaatctcaaagcggccttcttggttgcagtggtgtttttggggttgtcgacggcggtgacgatggtgtttgcgagggaggtggcgctggacccagtggcggcggcgaagcggaacgagggtgaggcgtcggggctcctcgccgtgttcaaggggatgaagaacctccccgtcgggatgccgtcggtgcttatcgtcaccggcctcacctggctctcgtggttccccttcatcctcttcgacaccgactggatgggccgcgagatctaccatggccgcccggacggctcccccgccgaggtcaccgccttccaagagggtgtccgccaaggcgccttcggcctcctccttaactcgatcgtgctgggcatcagctcgttcctgatcgagccgatgtgccgtcggctgggcgcccgcgcggtgtgggtgatgagcagcgccgtcgtgtgcgtcgccatggcggccgtctccgtgctcagcgcgtggtcgctcggcgacttcggcggctcggtgcaggacgcagcgcgggcgccggcggaggagggcggcgtcagggcgtcggcgctggcgctcttcgtcttcctcggcctccccttcgccgtcctctgcagcgtcccgttcgccgtcacggcgcagctcgcggcgagccgcggcggcgggcagggcctctgcaccggcgtcctcaacatctccatcgtcgtgccgcagatggccatcgccctcggcgccgggccctgggacgagctgttcggggaggggaacatcccggcgttcgccatggcgtccgtgttcgccgcc

SEQ ID NO: 9310 - DNA, 3332 bp, Oryza sativa
ctccactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggagaacataccgatcgaggaggtgttcgagcagctgaaatgtacgcgcgaggggctctcctccgaggaggggaaccggcgtatcgagatgttcggccccaacaagctcgaggagaagaaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcagatcctgaccctgtgcaactgcaaggaggatgtaaagaggaaggtgcatgctgtgattgacaagtatgctgagcgtgggcttcgttctcttgctgttgcaagacaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctgagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccatttatgcagtttccatcaccatccgtatagtgcttggatttttgcttattgctctgatctggaaatacgacttctcacccttcatggtccttatcattgccatcctgaatgacggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgcc

SEQ ID NO: 9311 - DNA, 1199 bp, Oryza sativa
cttctcccaccttctcccttctcctcgctcttccccctccgccgccgccgcagcggagcagcaacagcaggcgagcgacatgggagggtttgtcaagacccagaagacccatgcctacttcaagcgtttccaagtcaagttcaagagacggaggcagggcaagactgactacagggccaggattaggctcaccaaccaagataagaacaagtacaacacaccgaagtaccgctttgttgtgagatttacaaacaaagatatcacagctcaaattgtctatgctaccattgcgggtgatatcgtgatggctgctgcctactcccatgagctgcctcgttatggtcttgaagttggtctcaccaactatgcggcagcttactgcactggcttgcttctggctcgccgtgtgctcacgctccgtggtttggaccaggagtacgagggcaatgttgaggccactggggaggactactatgttgaaccagctgatgaaaggaggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggctgaggaggaacctgagaaattccaagcccactttagtgagtacctcaagaagggaattgacgctgatggcatggaatcactgtacaagaaggtccatgctgccatccgcgctgatcctaccatggccaaatcgaccaagaaggaaccggctacccacaagagatacaacctcaagaagctaacctacgagcagaggaaggccagtctcgtcgaaagattgaatgctctcaactcctcagctggtgctgatgatgatgacgaggaagaggatgacgagtgagagagtagccttatcacagtagtttcatcttatgctgccaaacaaactccttatggcatttaagtttacctgtagtcttgcaatttgcaacaggcatttttgtttatgttctgcactctgctcaaagaacctatttctttcggtttttgattctcaaccttgagctatcggttatcttatttatgtgagaagctgccgtttggat

SEQ ID NO: 9312 - DNA, 1168 bp, Oryza sativa
ccgacgccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtcaatcctgtgtctatatcttggtctctgcttc

SEQ ID NO: 9313 - DNA, 1604 bp, Oryza sativa
cacacttcctcaaatcctccaacacctcgatccattcgcagtagctgcgaggtgtctgacatggcgtcggggcagaaggtggtgaagccgatggaggtgtcggtggaggccgggaacgccggggaggcggcgtggctggacgacgacgggcgggcgcggcggacgggcacgttctggacggcgagcgcgcacatcatcaccgccgtcatcggctccggcgtgctgtcgctggcgtgggcgatcgcgcagctgggctgggtggccggccccgccgtgatgctcctcttcgccttcgtcatctactacacctccaccctcctcgccgagtgctaccgcaccggcgaccctgccaccggcaagcgcaactacacctacatggacgccgtgcgcgccaacctcggcggcgccaaggtcaccttctgcggcgtcatccagtacgccaacctcgtcggcgtcgccatcggctacaccatcgcgtcgtccatcagcatgcgcgccatcaggagggccggctgcttccaccacaacggccatggtgacccgtgccgcagctccagcaacccttacatgatcctcttcggcgccgtgcagatcgtcttctcgcagatccctgacttcgaccagatttggtggctgtccatcgtcgccgccgtcatgtccttcacctactccggcatcggcctctccctcggcatcgtccagactatctccaatggcgggatccagggcagcctcaccggcatcagcatcggagtcggcgtcagctcgacgcagaaggtgtggcgcagcttgcaggcattcggcgacatcgccttcgcatactccttctccaacatcctcatcgagatccaagacacgatcaaggcgccgccgccgtcggaggcgaaggtgatgaagagcgcaacgaggctgagcgtggcgacgaccacggtgttctacatgctgtgcgggtgcatgggctacgcggcgttcggcgacgcggcgcccgacaacctcctcaccggcttcgggttctacgagcccttctggctgctcgacgtcgccaacgtcgccatcgtcgtgcacctcgtcggcgcctaccaggtgttcgtccagccaatcttcgccttcgtcgagcgctgggcctcccgccggtggccggacagcgcgttcatcgccaaggagctccgcgtggggcccttcgcgctcagcctcttccgcctgacgtggcgctcggcgttcgtctgcctcaccaccgtcgtcgccatgctcctccccttcttcggcaacgtggtgggtctcctcggcgccgtctccttctggccgctcaccgtctacttccccgtcgagatgtacatcgcgcagcgcggcgtgccacgtggcagcgcgaggtgggtctcactcaagacgctcagcgcgtgctgcctcgtcgtctccatcgccgccgccgcgggctccattgctgacgtcatcgacgcgctcaaggtgtacaggccgttcagcggatgattcttctgattctctcttgctgctttgagcagagcatccactggtaaaaagtggacagtaattttctttttttacagtctatggacgtagtacagtaaaaaagtgtgtacaactgt

SEQ ID NO: 9314 - DNA, 1499 bp, Oryza sativa
gcgatgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatgagtgaaggtgtgattctttcttccatgatcgaatgaaccgtttcctgatgacccacattgcaagctggccatgcactctgcttagttgcttccaccttttggaagcatgcagaatagagacataaataaaagttgctttaaatctaacattttagttgggtagggatatgtaacctgcaatttagctttcttgaagtatgttcaacctgcaacatttgagtgacttgtaagtcttgagtttaactacaggtgttggataaccacaattgacagctc

SEQ ID NO: 9315 - DNA, 1667 bp, Oryza sativa
gcggccgccgccgccgttcctctcatctcggatcgccccaagcatgccgccatcgtcagaagcgggacggagtggacggcggcggcgcacgtgatcacggcggtgatcgggtccggggtgctgtcgctggcgtggagcgtggcgcagctggggtggctggcggggccggggatgatgctcgtgttcgcggccgtgacggcgctgcagtcggcgctgttcgccgactgctaccgctcgccggacccggaggtcggcccgcaccgcaaccgcacctacgccaacgccgtcgagcgcaacctaggtagctcgagcgcgtgggtctgcttgttgctgcagcaaacggccttgttcggctacggcatcgcctacaccatcaccgcctccatcagttgcagggcgatcctgaggtccaactgctaccacacgcacggccacgacgcgccctgcaaatacgggggtagctactacatgctcatgttcggcgcggcgcagctgttcctctccttcataccggacttccacgacatggcgtggctgtcggtcctcgccgcggtcatgtcgttctcctactcgttcatcggcctcggcctcggcctcgccaacacaattgctaatggaacgatcaaaggaagcataacaggtgctccaacgagaacccctgtgcagaaggtctggcacgtctcgcaggccatcggcgacatcgcattcgcgtacccgtactcattaatcctcttggaaattcaggacacactgaaggctccaccggccgagaacaagacgatgaagaaggcgtccatcatctcgatcgtcgtcaccaccttcttctacctctgctgcggctgcttcggctacgccgccttcgggagcgacgcccctggcaacctcctcaccggcttcggcttctacgagccctactggctcatcgacttcgccaacgcctgcatcatcctccacctgctcggcggctaccaggtgtacagccagccgatataccagttcgcggacaggttcttcgcggagaggtacccggcgagccggttcgtgaacgacttccacacggtgaagctgccgctgctgccgccgtgtcgggtgaacctcctgcgggtgtgcttccggacggtgtacgtggcgagcaccacggcggtggcgctcgccttcccctacttcaacgaggtgctcgcgctgctcggcgccctcaacttctggccgctcgccatctacttccccgtggagatgtacttcatccagcgccatgtcccgcggtggtcgccccggtgggtcgtgctgcagtcgttcagcgtcctctgcctcctcgtcagcgccttcgcgctcgtcggctccatccagggcctcatcagccagaagctaggctaaagatttagcctagcatcctgaatttcggatttgctttttctttgtgtaaccgtaatgggatgagaatgcatttggtggtcgtgtgttgtttgtaacaactggggagcggagctttgtccctggtgaatggcgcgatgaactcatgaacaatagcatagtggtggtggtacattgtgtctgcaggggtcagagggtggtggcactctgtttttcagtgcctttcctcctgtgctgcagagaaactgctcctatatatgtacagaatgtcgtcatattattgccatgatacttgg

SEQ ID NO: 9316 - DNA, 1834 bp, Oryza sativa
ctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctct

SEQ ID NO: 9317 - DNA, 1851 bp, Oryza sativa
ctccaaagcccaagctaatccccctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctcc

SEQ ID NO: 9318 - DNA, 1275 bp, Oryza sativa
cgaggatgaggctgaagaggatggtgcgaacatcgatctggattcacaaaggaaaggaaaatgcgttgttttgaagacatccacaagacaaacaatattccttcctgtaatcgggcttgttgaccctgaaaagctcaagcctggggatttggttggagtcaacaaagacagctacttgatactagacacgctaccttcagaatatgattcacgggttaaggcaatggaggtagatgaaaagcctacagaggattacaatgacattggtggccttgagaaacagattcaagagcttgttgaagcaatagtattgcccatgactcacaaggaccggtttcagaagttgggaattcgccccccgaaaggtgttcttttgtacggaccacctggcactggaaagaccctaatggctcgtgcatgtgctgcccaaactaacgccacatttctgaaacttgctggtccacagcttgtccagatgttcatcggtgatggtgcaaagcttgtccgtgatgcctttcagcttgcaaaggagaaatccccctgcatcatttttattgatgaaattgacgcaattggaacaaagcgttttgatagtgaagttagtggtgacagagaagtgcagcgcacaatgttggagttgctgaatcagctagatggattcagtagtgacgagaggataaaggtgatagctgcaactaatcgcgcggacattcttgatcctgctttgatgaggtctggtaggctggaccgaaaaattgagttccctcatccatccgaagaagcacgagctagaattttgcaaatccattcaagaaaaatgaatgtaaaccctgatgtcaactttgaagagttggcacgatctacggacgacttcaatggtgcacaactgaaggccgtttgtgtagaagcaggcatgcttgccctacgccgagatgctacagaggtgacacacgaggatttcaatgaagggatcatacaagtgcaagccaaaaagaagtccagtttaaattattacgcttaattcttccgagagagttattaggcctaaggaaacgctccgtccaaaattgtttgtttgtaacactaccgttttatatatttgtgtggttcaagatgtgattgtacgaaacatgtcttgcgctgttccttctctgcttgatatatactgatagaagttgactcgtcccttgcgtaattgcgttcacgtgtgtttggcttcttgcgtgtcaaaactggcaattcgaatactggacgatttaggattactcggctggc

SEQ ID NO: 9319 - DNA, 1717 bp, Oryza sativa
ccaatccgtcccgtctcctcgcccgccgccctcgactcccgtctcctcgcctgccgctggcgccgatctccatcctgctagcagaggtggcgccggcgtcctcctgctcccgccgcattcgcatcctaatccatcccatccggcctcggcctcgaatttcgtctcctcgcccgccgcttgcgccgatccccatcctgcgagcagaggtggcgcccggcgtcctccttcttccaccgcatcgtcgctcgccgctcatggatcctgagatctagacgtcaacgtgcttcctggaaagagagaggctcaggcatgagagcatacctctaaaataatgtccgtgcttacctgtgtgcttgataacatgggctcatcctgtagcagatctcattctttaagtgaggctgaaacaaccaaaaatgcaaaatctgcagacattgacaggcgaattttgcaagagacaaaagcagagcaacacatccacaagctcttacttcttggtgcgggagaatcagggaagtctacgatatttaaacagattaagctccttttccaaactggctttgatgaggcagaacttaggagctacacatcagttatccatgcaaacgtctatcagacaattaaaatactatatgaaggagcaaaagaactctcacaagtggaatcagattcctcaaagtatgttatatcgccagataaccaggaaattggagaaaaactatcagatattgatggcaggttggattatccactgctgaacaaagaacttgtactcgatgtaaaaaggttatggcaagacccagccattcaggaaacttacttacgtggaagtattctgcaacttcctgattgtgcacaatacttcatggaaaatttggatcgattagccgaagcaggttatgtgccaacaaaggaggatgtgctttatgcaagagtacggacaaatggtgttgtacaaatacaatttagtcctgttggagaaaacaaaagaggtggagaggtatataggttgtatgatgtaggaggccagaggaatgagaggagaaagtggattcatctttttgaaggtgttaatgcggtaatcttttgtgctgccattagcgaatatgatcagatgctatttgaagatgagacaaaaaacagaatgatggagaccaaggaactctttgactgggttttaaagcaaagatgttttgagaaaacatcattcattctgtttctcaacaaatttgatatattcgagaagaaaatacaaaaggttcctttaagtgtgtgcgagtggtttaaagactaccagcctattgcacctgggaaacaggaggttgaacatgcatatgagtttgtcaagaagaagtttgaagagctctacttccagagcagcaagcctgaccgtgtggaccgcgtcttcaaaatctacagaactacggccctagaccagaaacttgtaaagaagacattcaagttgattgatgagagcatgagacgctccagggaaggaacttgattcagagctaagactaggttgtaagtcacacagggaaggtaattaggacggcgagaggaacaaagtttcacactgtcacagctttatctgttgtaattcttttacacgtggaccattgattgatcttttggttcttactgtgggctgttcaggtctgtaccctattttttgttctctagttagccattgtgcaaattttccttgaatcagatt

SEQ ID NO: 9320 - DNA, 1347 bp, Oryza sativa
tttgaactccacctgagcacaggagaagccgcagccactgagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgc

SEQ ID NO: 9321 - DNA, 1520 bp, Oryza sativa
ccaacgcaaaccgcatcgatcaactccttccccaagtcgaagcaaaatccctagcgatgtcgtcgccgccgcccgccgccgccgccgcgatggccgtcgacgacgccgacgacgaccagctcgcctccatgtccacggaggacatcgtcagggcaacccgcctcctcgacaacgagacccgcgtcctcaaggatgagctgcagcggacgaaccttgaggtggaatcctacaaggagaagatcaaggagaaccaggagaagatcaaactcaacaagcagctgccttaccttgtcggcaacatcgtcgagatattggaaatgaaccccgaggatgaggctgaagaggatggtgcgaacatcgatctggattcacaaaggaaaggaaaatgcgttgttttgaagacatccacaagacaaacaatattccttcctgtaatcgggcttgttgaccctgaaaagctcaagcctggggatttggttggagtcaacaaagacagctacttgatactagacacgctaccttcagaatatgattcacgggttaaggcaatggaggtagatgaaaagcctacagaggattacaatgacattggtggccttgagaaacagattcaagagcttgttgaagcaatagtattgcccatgactcacaaggaccggtttcagaagttgggaattcgccccccgaaaggtgttcttttgtacggaccacctggcactggaaagaccctaatggctcgtgcatgtgctgcccaaactaacgccacatttctgaaacttgctggtccacagcttgtccagatgttcatcggtgatggtgcaaagcttgtccgtgatgcctttcagcttgcaaaggagaaatccccctgcatcatttttattgatgaaattgacgcaattggaacaaagcgttttgatagtgaagttagtggtgacagagaagtgcagcgcacaatgttggagttgctgaatcagctagatggattcagtagtgacgagaggataaaggtgatagctgcaactaatcgcgcggacattcttgatcctgctttgatgaggtctggtaggctggaccgaaaaattgagttccctcatccatccgaagaagcacgagctagaattttgcaaatccattcaagaaaaatgaatgtaaaccctgatgtcaactttgaagagttggcacgatctacggacgacttcaatggtgcacaactgaaggccgtttgtgtagaagcaggcatgcttgccctacgccgagatgctacagaggtgacacacgaggatttcaatgaagggatcatacaagtgcaagccaaaaagaagtccagtttaaattattacgcttaattcttccgagagagttattaggcctaaggaaacgctccgtccaaaattgtttgtttgtaacactaccgttttatatatttgtgtggttcaagatgtgattgtacgaaacatgtcttgcgctgttccttctctgcttgatatatactgatagaagttgactcgtcccttgcgtag

SEQ ID NO: 9322 - DNA, 1764 bp, Oryza sativa
tccccacccggcctagcgagcgagagagagggaagggttgcgacttgcgactcgcgagcggcgagatggcgaaggacgtggagatggcggtgcggaacggagacggcggcggcggcggcggctactacgccacccacccgcacggcggcgccggcggcgaggacgtcgacgacgacggcaagcagcggcgaaccggtaacgtatggacggcgagcgcgcacatcatcacggcggtgatcggctccggcgtgctctctctcgcatgggcaacggcgcagctcggctgggtggtcgggccggtgactctgatgctcttcgccctcatcacgtactacacctctgggctcctcgccgactgctaccgcactggcgatccggtcagcggcaagcgcaactacacctacatggatgccgttgcggcctacttaggtggctggcaagtctggtcctgtggtgttttccaatatgtcaacctggttgggacagcaattgggtacacaatcacagcatccatcagcgcagcggctgtgcacaaggccaactgctaccacaagaacggccacgatgccgattgcggtgtctacgacaccacgtacatgatcgtctttggagtcgtccagatcttcttctccatgctgcccaacttcagtgacctctcatggctttccatcctcgccgcggtcatgtcattctcatactcgaccattgccgttggcctctcgcttgcgcgaacaatatcaggtgctactggtaagactactctgactggcgttgaggttggagttgacgtcacttcagcccagaagatctggctcgcgttccaagcgctcggtgacatcgcgttcgcctactcctactccatgatccttatagaaattcaggacacggtgaagtctccaccggcggagaacaagacgatgaagaaggcaacgctgctgggggtgtcgaccacgacggcgttctacatgctgtgcgggtgcctggggtacgcggcgttcgggaacgcggcgccggggaacatgctcaccgggttcggcttctacgagccctactggctgatcgacttcgccaacgtctgcatcgtggtccacctggtcggcgcctaccaggtgttctgccagcccatcttcgccgccgtcgagacgttcgccgccaggcggtggccgggctcggagttcatcacccgggagcgccccgtcgtggccggcaggtcgttcagcgtcaacatgttcaggctgacgtggcggacggcgttcgtggtcgtcagcacggtgctcgccatcgtgatgcccttcttcaacgacatcctgggcttcctcggcgccgtcgggttctggccgctgacggtgtactacccggtggagatgtacatccggcagcggcggatacagcggtacacgtccaggtgggtggcgctgcagacgctcagcctcctctgcttcctcgtctcgctcgcctccgccgtcgcctccatcgagggcgtcagcgagtcgctcaagcactacgtccccttcaagaccaagtcgtgatcccgatcacgacggccttttttttttgcttttgcatcctgatgaaaaaagatttcagaaacatatgcacaacaaatgccggaagttagccaagagtttggtcaccagctcggtgcgttggtcggtcaggaggaggagggttcaacttgtgtaggttaagaaatgctagagagtatggagaccatcttcgattgctgctcatgtatagaaaaaagaggaagcttcgtattcatgt

SEQ ID NO: 9323 - DNA, 932 bp, Oryza sativa
gctaattaaggcgcaacacagaaaccctcaccgccgcccgcatccatggcggaggagcacgagacgaggccgccgtccgccggaaggccgccgtcgtccggccgcggcagggccgacgacgctgacgagagggaggagggggagatcgccgacgacgactccggccacgcgccgccgcaggccaaccccgccgcgccgcacccgctcgagcacgcctggaccttctggttcgacaacccgcagggaaagtccaagcaggcaacctggggaagctccatccgccccatccacaccttctccaccgtcgaggacttctggagcctttataacaatatccatcacccaagcaagttggttgtgggagctgacttccattgctttaagaataaaatcgagccaaaatgggaagatcctatctgtgctaatggaggtaaatggaccttcagctgtggcagaggaaagtccgacacaatgtggttgcatactttattggcaatgattggcgaacaattcgattatggggatgaaatttgtggagcagttgttagtgtgcgtggcaagcaggaaagaatagctatctggactaaaaatgctgccaatgaagctgctcagataagcattgggaagcagtggaaagaatttctggattacaaggactcgattgggttcattgttcatgacgatgcaaaaaagatggacaaaggtctcaagaaccgctacacagtttgatctgagcactcctgtccagatatccaagagagtagtatatccacatgtaggatgggttttcttcgatgctttagtgtttgtcattcgcttgtagcgagcgcttgaaggctataatattgccgtgaactgtttaaacttgaaacgtaatataatgacgtatcagaggtgtctctgtactctataaatcagtccagttcttcctt

SEQ ID NO: 9324 - DNA, 1901 bp, Oryza sativa
ttaaatcccgtgcgacgcgtagagacctcctcctccgctttctcctccaaagcccaagctaatccccctcctcttcctcgtcgccggcgagagctcttcgtcttctccaactcgaccggaagcaagcgcgcttccgatccgccatggtgctctcccacggcgtgtcgggctccgatgagtccgtccactccacgttcgcctcccgctacgtccgcacctccctccccaggttccggatgccggagcagtcgatccccaaggaggcggcgtaccagatcatcaacgacgagctgatgctggacggcaacccgcggctgaacctcgcgtcgttcgtcaccacgtggatggagcccgagtgcgacaagctcatccaggcctccgtcaacaagaactacgtcgacatggacgagtaccccgtcaccaccgaactccagaaccgatgtgtgaacatgattgcacacctcttcaatgctcctctaggggactctgaaacggccgtcggagtcggcactgtcggctcgtctgaggccatcatgctcgccggtttggccttcaagaggaggtggcagaacaagatgaaggcagccggcaagccatgcgacaagcctaacattgtcaccggcgccaatgtccaagtttgctgggagaagttcgcgcgatacttcgaggttgagctcaaggaagtgaagctgagtgacggctactacgtcatggacccagctaaggccgtggatatggtcgacgagaacaccatctgcgtcgcggcgatcctcgggtcgacgctgaacggggagttcgaggacgtgaagctgctcaacgatctgctcaccaagaagaacgctgaaacaggctgggacacgccgatccacgtggacgcggcgagcggcgggttcatcgcgccgttcctgtacccggagctggagtgggacttccggctgccgctggtgaagagcatcaacgtgagcgggcacaagtacggcctcgtctacgccgggatcgggtggtgcatctggaggagcaaggaggatctgcctgaggagctcatcttccacatcaactacctcggcgccgaccagcccaccttcaccctcaacttctccaagggttccagccaggtcattgcacagtattaccaactaatccgcctaggctttgaggggtacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctct

SEQ ID NO: 9325 - DNA, 2691 bp, Oryza sativa
cgcggcgaggcgacgaactcatcacctccactctctgctgcaacacgagtgaatcggaggcggcacgatgcgcaagtgggcgctctcctccgcgctcctcctcctcctcctcctcaccacactccccgatccagctaagaagctccaagtcaatgctgatgacagcactgatgagttagttgatccgccgaaggtagaggagaagattggtggtgttccccatggcctgtccacggactctgaggttgttcagagggaggctgagtcaatctcgaggaagaccctcaggagctcagcggagaaatttgagttccaggctgaggtgtccagactcatggacatcatcatcaactcactctacagcaacaaggacattttcctgagggagctcatctccaatgcttctgatgctttggacaagattaggttcctggctctcactgataaggaggttttgggcgaaggtgacactgctaagcttgaaatccagattaagctggataaggagaagaagattctctccattcgggataggggtattggtatgaccaaggaagatctcattaagaaccttgggaccattgccaaatctggaacttcagcttttgtggaaaagatgcagactgggggtgacctcaatctcattgggcaattcggtgttggtttctattcagtatacttggttgctgactatgttgaagtgatcagcaagcacaatgacgacaaacagcacgtctgggagtccaaagctgatggatcattcgctatctctgaggatacatggaatgaacccctgggccgtggaactgaaataagactgcacctccgagatgaagccaaggagtacgtggaagaagacaagctaaaggatttggtgaagaagtactctgagttcatcaatttccccatttacttgtgggcaaccaaggaggttgatgtggaagtgccagctgatgaggatgagtcaagtgaatcaagtgaagaagaggaatcatcccctgagtctacagaggaagaagagacagaagagagtgaagagaagaagcccaagacaaagacagtaaaggaaaccactactgagtgggagcttctgaatgatgtgaaggctatatggcttcgtagccctaaggaggttactgaagaagaatacacaaagttttaccactcacttgctaaggactttggtgatgacaagcccttgtcttggagccacttcactgctgagggagatgttgagttcaaagctttgctctttgttcctcccaaggctccacatgatctctatgagagttactacaactctaacaagtcaaaccttaagttgtatgttagaagggttttcatctctgatgaatttgatgagcttcttccgaagtatctcagctttttgaagggtctcgtcgactcggacacattgcctctcaatgtatcacgagaaatgctccaacaacatagcagcctgaagaccatcaagaagaaactaatccgcaaagctcttgacatgattagaaaacttgctgaggaagatcctgatgagtacagcaacaaagataagacagatgaagaaaaaagtgcaatggaggagaaaaagggccagtatgccaagttctggaatgagtttggaaaatcagtcaagttgggcatcattgaagacgcaactaacaggaaccgtcttgcaaagcttctgagatttgaaagtaccaagtcggaaggcaaacttgcctctcttgatgagtacatttcaaggatgaagccagggcagaaggacatcttttacattaccggaagcagcaaggaacaattagagaaatcaccgttccttgagaggctaaccaaaaagaactacgaggttatctacttcactgaccctgttgacgagtacttgatgcaatacctcatggactacgaggacaagaagttccagaacgtctccaaggagggtctcaaactcggcaaggactctaagctcaaggacctcaaggagtccttcaaggagctgaccgactggtggaagaaggctcttgacaccgagagcgtggactcggtgaagatcagcaaccggctgagcgacaccccctgcgtggtggtgacatccaagtacgggtggagcgccaacatggagaagatcatgcagtcacagaccctctcggatgccagcaagcaggcgtacatgcgcggcaagagggtactcgagatcaaccccaggcaccccatcatcaaggaactccgtgacaaggtcgcccaggacagcgagagcgagagcttgaagcagacggcgaagctggtgtaccagacggccctcatggagagcggcttcaaccttcctgatcccaaggacttcgcctccagcatctacaggtcggtgcagaagagccttgacctgagccccgacgcggccgtggaagaggaagaggaggtcgaggaggccgaggttgaagagaaggaatcatccaacatcaaggaggaggcggagccgtcgtcgtatgataaggacgagctgtagtgatgtgtcgccaccaactgttgtttttttatctagctcttgtgttaggttgtttaaaaatgtgatggtttcgagggacgtccatttttccatgcgaaaatgcttagtaccatgatacggggattttgtcgatgtacgtagtttgtgatactctagttcaaattaatggccgtctaatttcgatcaag

SEQ ID NO: 9326 - DNA, 1108 bp, Oryza sativa
aaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgtttc

SEQ ID NO: 9327 - DNA, 1682 bp, Oryza sativa
cccacctcctcgtcgcgggggggcccgtctcggctgcggcggcggcggcggcggcggagtaggccacggtggtggtggtggtggtgagtggggggaccatcgccgctggtggtcggttcagtcgggcgggcgggcgggctcaccggtcgttgacgaggagtttggttgaggggggccctgcggcatcagcggcggcggcgggatgtacgtgccgcagccatctcgctccgatgcggccggccgcgacgccggcgaccagcctagggtttaccaggtttggcggggaagcaacgaattcttcttgcgagggaggtttatatttgggcctgatgtgagatccatatttctcactatgttcctcatcgttgcaccagtggtggccttctgcgtgtttgtcgccagacacctcattgatgactttcccggtgattggggtatctcggtgatggttgtggtggttgtcttcaccgtttatgatttgacgctgcttctccttacttctggtagagatcctggtattatacctcgtaacactcatcctcctgagcctgaaggctttgatgggagcaatgattctggagttcagactccacaacagttgcgtctgcctcggacaaaggatgtcattgtaaacggaatcagtgtgaggattaaatactgtgacacatgcatgctttaccggccacctcgatgctcacactgttcgatatgcaacaactgtgtggaacggtttgatcatcactgtccatgggttggccaatgcataggacttcgtaattatcggttcttctacatgtttgtattctcgaccacgttactctgcctctacgtatttgctttctgttgggtgtacataatcaagattagaaatgctgagagtttgtcagtttggaaggcaatgctaaagacaccagcctcaatcgttttgatcatctactgcttcctttgtgtatggtttgttggtggtctttctgtcttccattgctatttgatgagcaccaaccagacaacttatgagaacttcaggtatcgctacgatagacgggctaacccgtataacagaggcgttctgaacaactttctagagatattctgcagccgtattcctccttcaaagaacaatttccgggcaagggtcacagttgagcaagggctacagcaaacccgtgtagcatcaagaggttttatgagccccaacatgggcaaacctgttggggatcttgaaatgggcaggaagccggtgccttgggatgaaccgaggacagcagctgatatcagggacttggaagcaggtctcgggggctttttggatgagaaagagggtagactaacgcatgcatccccagatctgagcagggacgaccttccagctgatctcatgaaaggacgagctggcacacattcaaggcggtcaagttgggttaatagaactggaacttcagaatcagagtgaccctgtgcattgaactaccatgaagtacaatttgtttaccatgtgcgccagggtaaaggtcctggatcatctgtgtaattccaaacacgcttcctgttgctttgtctttggtagtgcatgatatcacacgaagcttccatgcgctgtatgtgtgtctggtgttttaagaaaagtagcccaagagcttccggtttggatggggtatctgtatatatatttgttggaacag

SEQ ID NO: 9328 - DNA, 1162 bp, Oryza sativa
agcattcgcatccacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgccggcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacctc

SEQ ID NO: 9329 - DNA, 656 bp, Oryza sativa
attggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 9330 - DNA, 1727 bp, Oryza sativa
tattgaagaagcttccagctgagctgggggatcaaaatggaggtgcttcttccccttctccttgcctgctctctcctcttcaccattgcaacccctatcagagacatcaccgacgtttgtgcctcacagatcagtgatttccagcacctgaacagctccggactgcacctgacgctgcaccacccgcagagcccctgctcgccggcgccgctcccctccgacctccccttctccgccgtcgtcacccacgacgacgcccgcatcgcccacctcgcctcgcgcctcgccaacaaccacccgacatcgccgtcgtcatcgtctctcctccacggccaccgcaagaagaaggccggcggcgtcggcggctcgcaggcgtcgtcgtcgtccgtgccgctgacgccgggcgcgtcggtggccgtcggcaactacgtgacccgcctgggcctcggcacgccggcgacctcctacgtgatggtggtcgacacggggtcgtcgctcacctggctgcagtgctccccgtgctcggtgtcgtgccaccggcaggccggcccggtgttcgacccgcgcgcgtcgggcacgtacgccgccgtgcagtgctcctcgtcggagtgcggcgagctccaggccgccacgctcaacccctccgcctgctccgtctccaacgtctgcatctaccaggccagctacggcgacagctcctactccgtcggctacctcagcaaggacaccgtctccttcggctccggcagcttcccgggcttctactacggctgcggccaagacaacgagggcctcttcggccgctccgcggggctcatcggcctcgccaagaacaagctctcgctgctctaccagctcgccccgagcctcggctacgccttctcctactgcctcccgacctcgtcggcggcggcgggctacctctccatcggctcgtacaaccccggccagtactcgtacacgcccatggcgtccagctccctcgacgcctcgctctacttcgtcaccctgtcggggatctcggtcgccggggcgccgctcgccgtgccgccgtcggagtaccgcagcctgccgacgatcatcgactccggcacggtgatcacgcggctgccgccgaacgtgtacacggcgctgagcagggccgtggccgcggccatggccagcgccgcgccgcgggcgccgacctactccatcctggacacctgcttccggggctccgccgcggggctgcgcgtcccgcgcgtggacatggcgttcgccggcggcgcgacgctggcgctgtcccccgggaacgtgctcatcgacgtcgacgactccacgacgtgcctggcgttcgcgccgaccggcggcacggcgatcatcgggaacacgcagcagcagacgttcagcgtggtgtacgacgtcgcgcagtccaggatcggcttcgccgccggcggctgcagctgaggacccaaactgcagctggccgactcaagctaggtaaaagagcaatgctgcttcttctgctgctgccgccgcctcctatctctgctcaggcacagaagtgacaacttcttaactgcaaattcattcatcacatgtaaatgcatatacatgtgccaggaagttacgagtgtggctctaggacctagttttacatgtcataaacaaatatagatgtacaaataaatacagggtaactactttaggtgaagataatacttatcaatgtgaaagattattatgtt

SEQ ID NO: 9331 - DNA, 1813 bp, Oryza sativa
cccttcttcatcttcttctttttcgtcttcttcttcttcttcttcttcttcctctgatattgctgcaaaagaagaagaggtagacgaaggaggaggagatcaggtgatcatggggactcaggtggcagataactacccaccggccaaggatggccggagcgcgcaggagaaggcgatcgacgactggcttcccatcacgtcgtccaggaacgccaagtggtggtactccgccttccacaatgtcaccgccatggtcggcgccggcgtcctcagcctcccctacgccatgtccgagctcggctggggacctggcatcgcggtgctgatcctgtcatggatcatcacgctctacacgctgtggcagatggtggagatgcacgagatggtgcccgggaagcggttcgacaggtaccacgagctcgggcagcacgcgttcggcgagaagctgggcctctggatcgtggtgccgcagcagctcgtcgtcgaggtcggcgtcaacatcgtgtacatggtcaccggcggcaagtcgctgaagaagttccacgacgtgctctgcgagggccacggctgcaagaacatcaagctcacctacttcatcatgatcttcgcctccgtccacttcgtcctctcgcagctcccaaacttcaactccatctccggcgtgtccctcgccgccgccgtcatgtcgctcagctactccaccatcgcgtggggcgcgtcggtggacaaggggaaggtggccgacgtcgactaccacctgcgcgccacgacgtcgacggggaaggtgttcggcttcttcagcgcgctgggcgacgtcgcgttcgcgtacgcggggcacaacgtggtgctggagatccaggcgaccatcccgtcgacgccggagaagccgtccaagaagccgatgtggaagggcgtcgtcgtcgcctacatcatcgtcgcgctctgctacttccccgtggcgctcgtcggatactgggcgttcggcaaccacgtcgacgacaacatcctcatcacgctctccaggcccaaatggctcatcgcgctcgcaaacatgatggtcgtcatccatgtcatcgggagctaccagatctacgccatgccggtgttcgacatgatcgagaccgtgctcgtcaagaagctcagattccctcccggcctcacgcttcgcctcatcgcaagaacactctacgttgcgttcaccatgttcatcgcgatcaccttcccgttcttcggtggattgcttgggttcttcggtggattcgccttcgcgccgactacttacttccttccctgcatcatgtggctagcaatctacaagccaagaaggttcagtctctcatggttcaccaactggatctgcatcattcttggagtgatgctcatgatcctgtcaccaatcggaggactccggcagatcatcatagatgccaagacatacaagttctactcatagattacatgttcatcatagtaatctcatgtggctgcaagttcaagttctactcataggcacacatgatgaaaccagttactgcaaaagttttttttttagccaacaaaggaagaagaaagttcaacaccaagttcatacattgtcactacgacgatgatcttttgagacgtgtcatgcatgcatcagtcgttaattatgtgacttaattaaaaacaaagaggttgtgtttgtgcattgtcgctgggttaatcatactgtgtttttatatttcaatctactattatactgtaggctggacatggaaactgtgtgcagaaagatgaaagggatggataattactggttgattcttttgctttc

SEQ ID NO: 9332 - DNA, 1913 bp, Oryza sativa
tctataaaaggcgcagcccgtcgtcgagccctctcatccctcttctttgtctgatcgatcgattgcttctccctcctctcgctactagactagagagtaggtagagctagctttctagctcgtggatcgttaagtttgtagtcctgcccgggcgccggcggtgaggtcgcgatggccggcggcgcggtggtgagcacgggggcaggcaaggactaccctggcaagctcaccctcttcgtcttcttcacatgcgtcgtcgccgccaccggtggtctcatcttcggatatgacatcggtatatcaggtggtgtgacgtccatggacccgttcctgaggaagttcttcccggaggtgtatcggaagaagcagatggcggacaagaacaaccagtactgcaagtacgacaaccagctgctgcagaccttcacctcgtcgctctacctcgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggcgtcggcttcgccaatcagtcggtgccggtgtacttgtcggagatggcgccggctcggctgcgggggatgctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataatccgctcacgaatatcgtcgtccatgtctccgtcacgccctatattcttcttcttgtgttcatccccgtgtacagtagatgccttttattagtttgttttgttttgcctagtcagtcttcaatcttaatgtacgtgtgtttcttgtttggccaaattgatcttaattgctgtacctttcactgtc

SEQ ID NO: 9333 - DNA, 1284 bp, Oryza sativa
ggcaatcgctccacttgtcgcctatatacgccttggcctctcggcgtccgatgctagtggtagtggcccgcaaatcctcctcctccgctcgcgtcgccgcccaccaaacccgatcccaccgcgccgcgatgccggccggccagccgcacgcgcacgagcccgacggcggcggcgcgagccaccgccggccccagtcgccgccgtcgctccccgcggaggtggtcccggcgttcgcgccgccggagtcggaggacgaggagtcctgggtctggtcccagatcaaggccgaggcgcgccgcgacgccgacgccgagccggcgctcgcgtccttcctctacgccaccgtgctctcccacccctccctcccgcgctccatctccttccacctcgccaacaagctctgctcctccaccctcctctccacgctcctctacgacctcttcctggcttccttcaccgcgcacccctccctccgcgccgccgtcgtcgccgacctcctcgccgcccgctcccgcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttgagggcgacgcgccgaggtctatttctcttcctctctgtataatccgtagtgttgatatgccaaaaactgatgtacttgtcgtgctttgggtaatctgtactgtagtgttgtatcatcagccgttttatcagtcgaatgcccatgctcatgtactgataactggtgattgatgaaatgatgagtcaaataaaagttgtataacttttgatttt

SEQ ID NO: 9334 - DNA, 2649 bp, Oryza sativa
ggaaggacggcggcgccgccagcgagtacctcatcgaggaggaggaggggctcaacgagcacaacgtcgtcgagaagtgctccgagatccagcacgccatctccgaaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggcaacttttcttgtgtgtggcggttggtctttgggctggactaatcatcggatttgtgacagagtattacacaagcaacgcctacagccctgtccaagacgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactacgcaacctgtgtgaagatctccactgatgcatccatcaaggagatgattcccccaggtgctcttgtcatgctcagccctctcattgttgggatcttctttggtgtcgagaccctctcaggactacttgctggtgctctcgtttctggtgttcagattgccatctctgcatcaaacactggtggtgcctgggacaacgcaaagaagtacattgaggctggtgcatctgagcatgcaaggaccctgggcccgaaaggctcagactgccacaaggctgctgtgatcggcgacaccattggggatcctctcaaggacacctcaggcccctcgctcaacatcctcatcaagctgatggctgtcgagtcgctcgtgtttgccccgttcttcgccacccatggaggcatcctcttcaagtggttttagatggtgacgatagatttacgaggacgttatttttgccaggagggcgctggaaatcatccatatattatagagttcatcgagttgacacatatagttccctccgtttcctatttgttattactgtctgtccatcagtcgatcatgctaagcttattagcatcatacctgtgtctagtttttttgagtctggtagttgtagccgatgggagcaaatcactggccacctacaggtttggacaagagtaccttgaatttgcgttttcctgtaggttggatgatacgatgatggtgatgattattgtacgtgcacggaatgcacctgtctcagtgaaattttcccgggaaggttctgctgtttctttatgtccttgtgggaatgttaggatgatcttgtacaaaaaagaaaacaactctagtgatagggggtggagtacatgtgtgccaactaagtttgagttgtcttgaattattgaagtaaaatactttagct

SEQ ID NO: 9335 - DNA, 1939 bp, Oryza sativa
gatcgatcgattgcttctccctcctctcgctactagactagagagtaggtagagctagctttctagctcgtggatcgttaagtttgtagtcctgcccgggcgccggcggtgaggtcgcgatggccggcggcgcggtggtgagcacgggggcaggcaaggactaccctggcaagctcaccctcttcgtcttcttcacatgcgtcgtcgccgccaccggtggtctcatcttcggatatgacatcggtatatcaggtggtgtgacgtccatggacccgttcctgaggaagttcttcccggaggtgtatcggaagaagcagatggcggacaagaacaaccagtactgcaagtacgacaaccagctgctgcagaccttcacctcgtcgctctacctcgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggcgtcggcttcgccaatcagtcggtgccggtgtacttgtcggagatggcgccggctcggctgcgggggatgctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataatccgctcacgaatatcgtcgtccatgtctccgtcacgccctatattcttcttcttgtgttcatccccgtgtacagtagatgccttttattagtttgttttgttttgcctagtcagtcttcaatcttaatgtacgtgtgtttcttgtttggccaaattgatcttaattgctgtacctttcactgtcaaagagcgtcccttgttaccattatcacacggaaagattaatcaattaatttcactctgtatgtacagcaagaataac

SEQ ID NO: 9336 - DNA, 1962 bp, Oryza sativa
tgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcat

SEQ ID NO: 9337 - DNA, 1235 bp, Oryza sativa
gcttctccaattttccaagcctgcctccaagcgcacgccacgatcttctagaagcgattcgcgcgcgccgccgcctcctcccctccccttccccggagcgaagccgccccgccgggggggatgtcgccggcggcggacagcgcggcgtcgaagcggcaggcggagctgctcaagcaggagggcaacgccttcttcaagaaggaccgcatcagcgccgccatcgacgcctacaccggggccatagctctctgcccaaaggttgcagtatattggaccaaccgagcactttgctacaagaggcggaatgagtgggttagggctgaggaagattgtagaacagctattcagcttgacagccactctgttaaggcacattacatgctcgggcttgcacttctcaacaaggacgaattggccgagggaataaaagaactagagaagtcgttggagcttggaaggggtgcacatccagcaagttacatggttgaagagatctggcaagagctttctaaagcaaaatacatagaatgggaaaatttatcaagcgaacgagtccgtcaattgcataagctgaaggaagcatgtaaagaagctcttaggaattataacagccttgacaatcctcctgcatatgtccccgaggaacagctaaatgagcttgaggaagtttttcggaatgccaggaagtctgatattccaacagaagttcctgatcatctctgctgcaaaattactcttgatattttcagagacccggtgataaccccaagtggaatcacgtatgagagggcggtgattcttgatcatcttcatagggtggggaagtttgatcctgtgacccgtgagacacttgaaccacaccaactggttcctaaccttgccatcaaggaagctgtccatgcatttttgagtgaacatggttgggcttacaggatgagatgactactttgaattacacctgggcttggagctttggaggcaacatttcagattgcaatatacatgtttcggttagtcaacttaaatgtgtcattttgtttatctttacatatttattggtggaaaaggttttacctgggatggctgtgtacagattccccttctctagctatccctcctctctactctgttcatgtgtaatgcttggtatcagattatcacttatccacagtaaaagaaaattaaagtggctgtcatactccttgttctctgattattggtttttggcgcactcg

SEQ ID NO: 9338 - DNA, 1158 bp, Oryza sativa
aagcattcgcatccacgagaccactcgaacccgacccgcctcgccgccgccgccaccgaagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtcc

SEQ ID NO: 9339 - DNA, 1158 bp, Oryza sativa; identical to SEQ ID NO: 9338

SEQ ID NO: 9340 - DNA, 1158 bp, Oryza sativa; identical to SEQ ID NO: 9338

SEQ ID NO: 9341 - DNA, 1158 bp, Oryza sativa; identical to SEQ ID NO: 9338

SEQ ID NO: 9342 - DNA, 1257 bp, Triticum aestivum
caaccactctccactccacttttgtacgaagaacactagtgaaatatggctgcccagaacaacaaggaggtggatgccctggtggagaagatcaccggcctccacgccgccatcgccaagctgccgtcgctcagcccatccccagccgtcgacgcgctcttcaccgagctggtcacggcctgcgttcccccgagcccagtggacgtgaccaagctcggcccggaggcgcaggagatgcgggagggcctcatccgcctctgctccgaggccgaggggaagctggaggcgcactactccgacatgctcgccgccttcgacaaccctctggatcacctcggcatgttcccctactacagcaactacatcaacctcagcaaactggagtatgagctcctggcgcgctacgtgcccggaggcattgccccggcccgtgtcgcgttcattggctccggcccgcttcccttcagctcctttgtcctcgccgcgcgccatctgcccgacaccatgtttgacaactacgacctgtgtggcacagccaacgaccgtgcgagcaagctgttccgcgcggacacggatgtgggcgcgcgcatgtcgttccacacggccgacgtagcggacctcgccggcgagctcgccaagtacgacgtggtcttcctggccgcacttgttggcatggccgccgaggacaaggcgaaggtgatcgcacacctcggcgcacatatggcggacggtgcggctctcgtcgtgcgcagcgctcacggggcacgcgggttcctgtacccgatcgtcgacccccaggacatcaccctaggcgggttcgaggtgctggccgtgtgccacccagacgacgacgtggtgaactccgtcatcatcgcacagaagtccaaggacgtgcatgtgagtggacttcacagtgggcgtgctgtgggtggacagtctgctcgcggcacggtgccggtggtcagcccgccgtgcaggttcggtgagatggtggcggaggtgacgcagaagagagaggagttcgccaacgccgaagtggccttctgatcgatcgttgccaaggaacaataatgtgcatgtggtaattttcgaacctagctgcttgatcgcctgcaaccacacgtggtaattgtcctactgctaatgcatttcaagccatgtgctgtttgtacccaataatgtaagtctggtgtttacacgcgatacgccttgtatacaccttgtatgtgcaagtgttgggaatgatacttttgctat

SEQ ID NO: 9343 - DNA, 1206 bp, Triticum aestivum
ccaagagcgaactgagatcatcctaggaccaggcgcgaccacacaggacaagatgctgctgcttaatccggcgtccgaggcggcggcggcggcgctggacagcatccggcagcagctcctggaggagccaatggcgccggcgcggccggcgtactgccggagcgcgagcttcggcagcctggtggcggaccagtggagcgagtctctcccgttccggcccaacgacgccgacgacatggtcgtctacggtgccctccgcgacgccttctcctgcggctggctccccgacggctccttcgcggccgtcaagcccgagcccctgccctcccccgactcctacgacggctgctgcctcggcagcttcctcgcgtcgccgcccgggctggacgcgccgtgggcggaggaggccgaggtcgcagcgacggcgtcaagggggaagcacttcagaggcgtgaggcagcggccgtggggcaagttcgcggcggagatccgggacccagccaagaacggcgcgcgcgtgtggctcggcaccttcgacagcgccgaggacgccgctgtggcgtacgaccgcgccgcctaccgcatgcgcggctcccgcgcgctcctcaacttcccgctccgcatcggctcggagatcgccgcagccgcgggtcagaagcgtccgtctccccagccagcgagccccgactctcctcctccctcctccagcgcacccgggtcgtcgaagcggagaaagagaggcgaggccgcagcagagtccatgtccatggctctggtgccgcccccgccggtgcaggctccggtccagctgaccctcccagtccagccgtggctcgccaccggcgccgtccagcagctagtgagctgaagcggcgaaagcaacaagtgatcgttctcatgaccgatggccattagttcttccttcatggcttcatgtgttgagcccatggaggaacagagcatcaagatggcgtcaatggcgtaatgcgtcgctcgaagaaaccttgatcagttggaggcaattacgcgccacgccattgtgaaatttgtgtggctccgtgtgaaacttgtcgctagggttagtggcgttggcacagtagcaagtgggtgcagtggaatcccgaagctggtttgtaagaggtggtgagggtgcaggtgcaaaagttgcacagaccttctcctctccaatggagaatcttctttgtt

SEQ ID NO: 9344 - DNA, 1882 bp, Zea mays
gaaagatttttcttccctcctccgacgccccagcccaccaacacactctataaagcagccctcagtcacacacagaacgcacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgtgggcatcgtgacgatcttcggcggccggctggacgagcggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcggcgggcaccggcctgctgggctgcctgatgcggtcccggggcgacgacggcgcgccgctcctgagcgacgagcagatcgccgacaacgtcatcggcgtgctgttcgcggcgcaggacacgacggccagcgcgctcacctggatcgtcaagtacctccacgaccaccccaagctgctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtggaaggtgatgccgctcttcaggaacatccaccacagcccggactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtggcaaatcgttggatccagtgacgaggtcgagtacagcccgttccctgtgcccaagcacggcttgcctgtcagattatggagacaaaacaatccggtcgacagaaaggggcgtgagaccgacgacgatcatgtggagaggatatttatttagtttgactcttgagttaggcatgaatttaaccccaagctagctagagaagttttttttcccctttgaaattcttctttgctcgcctcttcctcctggatcaaattgcgttggaggagaagaaacggcagctttctctctttcgttttctttgcctgcttcaccgctacgataatggtgaaaatatgtaagctacgtggacatcaatgatccacagcatcgttgatatatataatatatagagaaaattctctgc

SEQ ID NO: 9345 - DNA, 1645 bp, Zea mays
cgccctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgaggcggcaggggacggcaactcgccggaggctggccgctgcctcgacgcgctgcggcggctgcgcgacattcgcgtcaacaccgacatcctcgtctcgacgcagatatgcctcgtcgaatcgacggcctgtttcccctccctctcctctaagacgacgccgggtagacgcgcgcaagaaacagggccttcgtttggaactagatctattgagttcctgtctctattttgggtggatactggataggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggtgaggcccgtgaagattgaaaagaactctgcatcagcaagcatgaagcttgagaaaagagatgtggatgttaggggtcagaagcctaacaatgtcaaagttgagaagactactagtaatggttccaaagctcaatctgtgaaggtggaaagggtatccaaagaagtcataaggactcctgactcgaagaggccagcatccgtccccaatggccacccaaagcttacatctcttgtcaaatgcaatgatcctacccgagataaaatccgggaactacttgctgaagcctttgtaagtgtttccagagagactagtgatgatgacagagacgaagtgaaaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccagacataccccctgatgagatggctagcgacgcaaggaagcaagagaacatgcagatcaaggagaaggctctgttcgactgcgagcgtggagcggcaccaaaggcgacgacggaccagttcaagtgtgccagatgtgggcagcggaagacgacttactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaacttttttccccttttttaccccccgtaaactaggagcagttatcctcttcctctgtcaggcagcctcctgattcattcagattgtactagtcgaacgcgtgaatgttgttgacttgatcgcatcgtcaccagatgtgaatgttcttgggtggagttagaat

SEQ ID NO: 9346 - DNA, 1172 bp, Zea mays
cccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcc

SEQ ID NO: 9347 - DNA, 1678 bp, Zea mays
gtcctgcccacgcgacgcgagagcgggagcggtgggtcgagtgacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgcactaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaaaatccagatcctgaggggcgccgacaacgacccgagcaaggacatcgtggagatgaagtcggaggaggcctaccggctggtgctgcaccaggtggtccggtggctggagcgcaacgtggaccccggcaagtcacgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgaattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttacc

SEQ ID NO: 9348 - DNA, 1148 bp, Zea mays
atctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgagaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatttgattgtcggaaataaaacatgggtgatgaatgtgtaccctccctaatctatgaagttgagaaagccctgcgggtgtaggtggatttgt

SEQ ID NO: 9349 - DNA, 2014 bp, Zea mays
gcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaggcggggcggggggaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctattgggctccctttctggccgagtcgaattcggatgatgctgttgtgcaccggatcgcggatcggattgtaagagggacatccattgagaagcatgccaagttttggaagggggctgacatcttggtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaagggtttgagttgcgaggtgcacggtgaagttggggtctctctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggtgttggtgtcc

SEQ ID NO: 9350 - DNA, 1729 bp, Zea mays
ggcaaccgagcaggaagaggaggaggatcccgtcctcccagtctagagcagccgcttgcaaagcgcatcggcggcacggccgtggattccgcgaatctgccaccgcttgctgctgcttctgagactgacaccgccatcgcagctgatggggatacccagcgacggcgacgacgtggtgcaaatccggcacgccgacgccgccggcgagcccaccgtcgtcaccgtgagctgccccgacaagacaggactgggctgcgacctgtgccgggccgtcctcctcttcggcctcagcgtcgtcaagggagacatgagcaccgacggccgctggtgctacatcgtgttctggctgttgccgcgcgggcggcggcccgtggccgtgccgtgggacctcctcaaggaccggttgcttcagctctgccccgtcgcgccgccattcggcttcgggtcccacgacgcgtacctcgcggcggcggctggcctgcaggacgttccgcctcccgcgccacagctcttcctgctcaagctatgctgcttcgaccggatgggactcttgcacgatgtgacacgcgttttgtgtgagctagagctcacgatccggagggtgaaggtctctaccacgcctgatgggagtgtgctggaccttttcttcatcacagatgccagggggcttctgcacacaaagagcaggagagaagaaacccaggacagactcgagagcgtcttaggcgactccttgacatgttgcgaaatagatcctgctggcgaagacatggtgtcttgctgcctccagtcctgggcctgggcttcgctgacgcctgctgttatagcacagatgtttagcacagctgatcgcgtggaggagcaaccgatcggcacaaggggtggtggtggtggtaccatcatctccgtgacgatggacaactcgcttagccctgcccacactcttattcagattcagtgtggcgaccataagggcctcctgtatgatgtcatgaggatagtcaaagactgcaacattcagatttcatatggccgattctacgcgagccaaaacggaaggtgcgagatcgatctgttcgcggtgcagtcggacgggaagaagatccttgatcagcacaggcagagagcactgtgctgtcgcctgaggatggagctccgccgaccactccatgtggcgttggtgaaccgaggtcctgacacggagctgctggtagcgaacccggtcgaggtttctgggaagggtaggccgctggtgttctacgacatcacccttgctctcaagaatcttcagagacgaatcttcttggctgagattgggaggcacgttgtggaaggcagggagtgggaggtctacagattgcacttcggtgaggagcacgagctctcgtctgcgctgcggaagaagattgtggatgcagtcaccaacatgctgatggggtgggactgatggcactgctgctgctgccgtgcctcggtctgaaacattatgcttagtgttcttccagaaactaacctatttggtgcaagcaaagaagaaacaactgatctctatctcttagatgcagcggttttcagctaatgcagagaccatgaaacctttggttatctaaacatgcactaggaaccggggtcctactacttagtgggcaccagacctgatgtatatgcatatactgaagcatgatcaagagtcatgtgtggcatatatataccattttgtctttgtcag

SEQ ID NO: 9351 - DNA, 1863 bp, Zea mays
gcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgtggcgttcccggtgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctagctaagctaataattcggaatcagcgaacgacgtaccctactaccagtagcagattattgataagggagtcaaacacatattgcgtgtgtgtgtcttttaaagtgttcgtttagaatggcttgagaagctcatccgtgtagtaaatttggagacttcgaaatataataaatatgttcgtagttggcaagct

SEQ ID NO: 9352 - DNA, 1046 bp, Zea mays
gcgcggacatgctgctgacggaggcggagctggacctgggcctggtgcggcgcgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatcctttttttttattttattttattttatttttagcttggatcagttggggttttgaacattgctagtgtcgtgtgattgggaaggctaatgtgatgccttcgatgcagagttttcaatgaatgccttggtgcaaacgtacgattgtgtaataatgccttctattgatcagcgactccaatagtccaatgtgc

SEQ ID NO: 9353 - DNA, 1128 bp, Zea mays
ggccggcaccgctgctagcttgctagcatacttcccctacacgcgcgcgcaaccgcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcgcggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaacgtctcctccatcgccagcgtccttggcttcccgcaggaagttatgtacagcgtcaccaaaggaggactgaatcagatgacgagaagtctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatattctctattctactgtatttgaatttgttttcgttcttgatcggccatgtatcaccgtcagacgtcagcggcaataatccggccgccgtcagctagcgccatgcaagctgcccgatcatgcaaggtgcagacactgtcgttgcctgcagttctgttcctttttctactatggtttcttgtattcactgcccactggtgatgtttctgtgataacgacttcgacagaggggatacatttt

SEQ ID NO: 9354 - DNA, 1334 bp, Zea mays
gtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtg

SEQ ID NO: 9355 - DNA, 1295 bp, Zea mays
cacaccgctgcttcaagaaaccaccgagagcccaaccgcacaggcaggagagagagcagggagccagggacagtagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaagctgccgcgggtgtgctgagacatgtggggaatgtattgtctgcccacgcctagtttctctgctgaatcttccatctctcttcccttcaagactgctcactgctgcactgctctgttatctgaacccagaacttcgtgtactcctgtaccgagctgtgtgtatgttttttttttcttccatcgtgtttgttgcaagggttcccgtctccttttatgcgttgggatcgtggcaagaaagggcagatatcatgtggaaacgtgggtttataactatcagctggatttttcatccaagtggaatcgattcagaattttctttt

SEQ ID NO: 9356 - DNA, 1414 bp, Zea mays
agcgatttcgccgggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcgg

SEQ ID NO: 9357 - DNA, 1381 bp, Zea mays
ctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaataattgctttggtttctgcccagcgcgcgaacgtgttagcgtgtaatctctattttgcactatccagcgactaataaaaagaaacgggtatatatatatatatatatatatatatatatatatatatatatatatatatatatatatatatatatatatatatatatatat

SEQ ID NO: 9358 - DNA, 2216 bp, Zea mays
ggggattccacatcgtaaccactgaagacgaggcggcggacgagacggagagcagaaccgcgcagcgaagcagcagcggcgacaagccctcgcgtcggtagaggcgccgtccgccgtccgccccctcaactccggtagccgctggccgctgcaggtcgagtcccgtcgagccgactcgcgcttcccgatctgggtggccgcggcgccggcatggcgcggttcgaggtgaacggcaagtcggtgcaaggcgtggacttgctgcggcggcgccactggccgtcgcgcctcgacttctggcccttccttgcactctatgcgctctggctgctgcttgctgtcccggcgctcgacttcactgacgctctcatcatccttgccgcgctctccgctgctcacattctcaccttcctcttcaccgcctggttcgtcgatttccgtgccttcgtcgggtactctaaggtcaaggatatccatgccgctaacacgtgtaaggtgactcctgctaagttctcggggtcaaaggagattgtacctctgcacaaacagaaaaatgtggcctcaacttcagctgcaggtgagacagaggagatttactttgattttcggaagcagaggttcatctactcggctgagaaagataactttttaaaactccggtacccaacgaaggaattgatcggtcattatggcaagggcactggttatggaactgaggccaagattagcaccgcagtggacaagtggggcagaaatgtattcgaatatccacagcccacatttcagaaattaatgaaggagcaaatcatggaaccattttttgttttccaggttttttgtgttgctctatggtgcctggatgcgtattggtactacagtttgtttacacttttcatgcttttcctgtttgagtctactatggcaaagaataggctgaagacattgactgagctaagacgtgtgaaagttgatagccagattgtgttgacctatagatgtgggaaatgggttaaagtccctggaactgaactactaccaggagatattgtgtcaataggccgctcaactagtggtgaagatagatctgtaccagcagatatgctattgttagctgggtctgcaatagtaaatgaagctattcttacaggagaatctactccacagtggaaggtttcaattgctggacgtggtcctgatgatatgctatctataaggcgagataagaaccatatcctatttggtggcactaaagtattgcaacacactgcagataagtctgtaaatcttcgatcacctgatggtggctgtctagcttttgtattgaggactggatttgagactagccaagggaaattgatgaggactatcttattttcaactgagagggttactgcaaataacaaagaaagtggcctgtttatactctttttgcttttctttgcaatcattgcgtccggttatgtgcttgtgaagggattagaggacccaacaaggagcagatataaacttttattgagctgttcgttgattattacttctgtgataccaccggaattgccaatggagctctccatagcagtcaatacatctttaattgcattggctcggcatggtattttctgcacagagccattcagaataccatttgctgggaaggttgacatatgctgctttgataagacagggactctgacatcagatgatatggaatttcaaggtattgttacatcggaaggtgatgacttaatatctgatgcaaataagctgcctctccgaactcaagaagtgctttccagttgccatgcactggtatttgttgacaacaagctggttggcgatcccctagaaaaggctgctataaagggcatagactggatctacacatctgatgagaaggccatgtccaaaaagcctggtggtcaacctgttcaaattgtgcacagataccattttgcttctcacttgaagagaatgtctgttatcgtccgtattcagcagaaattttacgctttcattaagggtgcaccagagaccatccaagagaaattagttgatttacctgctgcatatgtggagacatataagaaatacacacggcaaggttctcgggtcttggctcttgcatataaattgcttcctgagatgcctgtaagtttctgttgatattaatcatgtttgcctatagcctttcttatctagtattctgttattcttttgtc

SEQ ID NO: 9359 - DNA, 1446 bp, Zea mays
cttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactgtaggagaaggagagagagatggagaacggcggcgctaaaggcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgatgtgaggaaggagataaacttctgcaagaaggtcggtgttcctgtcctaggtgttgtggagaacatgagtggtctgaggcagccgctttcagacctcagattcatcaagtcagatgaggcgggcaagacagatgcgacagaatgggccctgaactacatcaaggagaaagcccctgagcttctgtcggtcatggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcgaaacatcgtgaagaagctgatcaaggccgagtgagaaaataatgttggcctgctggggaatctggtagtgagaaatgagatgaaatgacagatgccagagttctcgttaccaatatatatatatgttacggcgttacacactgaatctgtattagtgcttgtgttggacctgtaagtttttgttcgtgaataatcagtgggtgcacagact

SEQ ID NO: 9360 - DNA, 2661 bp, Zea mays
gtgctagcagaagacaaggagtttgcattggtttgagtgaggtcatgggcagtgcaggaaaacaccagctattaagttttatggatgaacttattcctaccattcgtactgctctatgtgacagcacccaagaggtccgtgaatctgctgggttagcgtttagtactctgtacaagagtgctggactgcaagccattgatgagattgtccccacattgctacgagctttggaagatgatgatacatctgcaacagctcttgacggtctaaagcagattttaagtgtcagaacagcagctgttttgccccatatattgcccaaattagtccagcctcccctctcttcattcaatgcacatgcattaggtgctctagcagaggttgctgggccaggtttgaattcacatatcggaactgttctcccagcattgattcttgctatggatgatgaagatgcggatgtacaaaactcagccaggaaagctgctgaaactgttctgttggttattgatgaggaaggagtggaaactttgatacctgagcttctaagagggatcaatgacagtcaggcatcaatgaggcggggttcagcctatctaattggtttcctctttaaaaacactaaattatatttggctgatgaggcttctgatatgatgtcaaccctaataattttgttgagtgatacagacaaggctactgtatcggctgctttagaagcattttcaagagttgttgcatctgttccaaaggaacagctcccgacgcatataaaactagtgcgcgatgctgtctctacagccagagataaagagcgtagaaggcgaaagggtgtgcctattcttgtgcctggcttatgtcttcctaaagcactgcagccttttcttcctatatatcagcagggtttaattagtgggtcggccgagacaaaagaacaggcagctgaaggtctaggagagttaattgacgtaacaagtgagaagactcttaaggaagttgtagtgccaattacaggacctcttattcgcatccttggtgatcggtttccatggcaagttaagtcagctatcctatcaaccctgacaatcatcatcatgaaaggtggaattgcacttaagcccttccttccacaacttcaaactacatttgtaaaatgtctacaggataataataggtctgtccgggcgagggctgcagctgctctgggaaagcttagtgctctcagcacacgggtggatcctttagttagcgatcttctgtccatgttgcagtcaggagatgaatctgtcaaagaaagtgtgctttctgcgcttaaaggtgttatcaaacatgctggtaaaagtgtcagctctgcaataaggtcacgtggatgtgctcttcttgaagatctgctgcaggctgaagctgatgatgtccgcagttgtgctgcaaaagtgattggcacattgtctcagtacatggaggagacagagatttcagatttggtgcaaatcctattgaacatgagcacttcatcagactggtgtaccagacatggtgctttgttatcgttctcatacatatcaatgcattctccatcaaaattgtgtcatttggcatcctttccatctctggtcgatcttttgaaaggttctctcaaagacgacaagttccctgttcgtgaagttgctacaagaactctgggaaagatactctgttttgagctacagccagaagctggcaccttgcaacttgttcagctgcttatcttggccttgcgtgatgattcaagtgaagttaggagaagatctttgtcgtgtatcaaagctgctgcaaagacaaatcattcagctcttgctacacatcactctatattgggcccggcaattgctgaagctttgaaggactctagcatgcctgtacgtctagctgcggaacgctgcgcccttcatgttttccagttaacgaaagggccagataatgttacagcagcacaaaagtacctcgggatgactggcttggaagtgaagaaaatcgcaaagcttgacgtggacagtgatggtagtgagagcagcgatgatgacaagaggacatagactctactcaacagcaatcttttttcggttcagttgttatgatctttacatatagttagctacattgatagcggaatgtggggtcattttttctgtctggcccattttgtgtacatcctttttgacaacaaacaggtaaaagtgacaacgtttgcaaatcgacaaacaatggacacaagttgtattgcaaccaaggactgattcgttagtttgagcacagcacaaccacccagttcaacgataacgcatgtcaatgtaagccacgcataccatatagtatcatatcgtcgagtattgttcgtaccacatcttcctcccagttgatctccttgggcaaggtaggcccttccctggacagctcgttgggcatcttgttgagcatgctctctgctctgtacctgaacgctggagtccacgaacagactgctctgagcggcgtcaatgtggataggaatgtaatcggacgtatattactggttccatgtttgttttcatattttctcattggatattaatgcaaatattatcgagttgggcatcggatattaatgcaaatattatcgagttgggatttgtgtcggataat

SEQ ID NO: 9361 - DNA, 1354 bp, Zea mays
gatccaattgcttcattcggggtagtaattttacaaagcccagttatggggatacattggtttcaaaaaaaaaaactcgaaattctcccgcctatccaccttgaattggattggatttgcttcgagcagtcagtcttgccgaagtttttaggagttctccgacctcgtagtcaatcactcagtctcggagacacacattgccactgcgatggccgcccaccaggactcggcggcatcggggagcgggcctcctcgttgtcctcgcgtcctcctggcagcctccggcagcgtggccgccatcaagttcgaggtcctctgccgcagcgtcgccgagtgggcggatgtccacgcggtggcgaccgcgtccgcgctggaattcatcgacgtggcctccttccccggcggcgtccctctctacaccgacgaccaggagtggtctagctggaagcgggtcggcgacaaggtcctgcacatcgagctgcgccggtgggccgacgtcctggtcatcgcgccgctctcggccaacaccctcgcaaaggtacgccgtacgcacgccagctggtcatcgcgctcgccctcaccggtcgccgctgacaactctgcctgctgccaggtcgccggcgggctgtgcgacaacctcctcacctgcgtcgtgcgcgcctgggactacagcaagcccgtttacgtcgcgccggccatgaacaccttcatgtggggcaaccccttcacggcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatatggcagtggagcgcttctcgtctttcatttccccgtacagatcgtcaagcaccctgaaaacctcctcagcttcagacggcggcgcgctccaggccgtgaaggcgaacaccttgttcctcacttcaatccagctctgccccggattcttcctcaaccctgcctccttcatcgtcatcctcaccctcttggagtcgtcccacatcccacacgcggcgtacaggtttgtgatcagcgtgcggttgccggtggttgccgtctcagcctgcagaactttggccatggcagcttcggccagtgctgcatccccgtgaatcctgcaggagttgagcagcgctccccacacgcacaggtcaggcttcatcggcatcgtatcaatgagctcacacgcgcccctcagcaggccagcacgccccaggagccc

SEQ ID NO: 9362 - DNA, 2903 bp, Zea mays
gctgcggcgtgctccttcgctggaaagtggggcagtatcttttcgcatctcctcgactccgcctctctcggatctcgccgaaggacgagcaaaggcccctgatcgcccgcttctactacaactatattctgtcgccagcgcacaagcggcgggggcacggggtagattcggagcggctcttggcttgcagtccagacgcccttcacccctgatctggaccggagggagcggctccttccgtcagttgttcttgctttgcctgggcctcttccgcctgcttcgtgttcttcacaggagccggtgacctcggacgatatcttggaggacaagatgtcgggggctgttcttgtcgccatagtcgcctccatcggcaatctattgcaggggtgggacaatgccaccatcgcagctgctgttctgtatataaagaaggaatttcaattgcaaaatgagcccactgtggagggactaattgtgtcaatgtcacttatcggcgccaccatcgttactacattctccgggccattatcagactcgattggccgacgccctatgcttattctctcttcaattctgtacttcttcagcggcctcatcatgctatggtctcctaatgtctatgtcctgctgttggcacgcttcgtagatggatttggtattggcttggctgtcacgcttgtgcctttgtacatttcagaaatagccccttcggagattagaggtttgctgaatacactaccacaattcagtggatcaggaggaatgttcttgtcatactgcatggtgtttgggatgtccctgtcgccatcacccgattggagaattatgcttggtgtgctcgcgataccttcattgttcttctttggtttgacaatattttatcttcctgaatctccaagatggctcgttagcaaaggtcggatggcagaggcaaaaaaggtgttgcaaaagttacgggggaaagacgatgtctcaggtgaattgtcccttcttctcgaagggttggaggttggaggagacacttccattgaagagtacatcattggacctgccaccgaggcagccgatgatcttgttactgacggtgataaggaacaaatcacactttatgggcctgaagaaggccagtcatggattgctcgaccttccaagggacccagcatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcagcatgccaaaaatgagcagtgggatgaagagaatcttcatagggatgacgaggagtacgcatctgatggtgcaggaggtgactatgaggacaatctccatagcccattgctgtccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtagaaaggaaggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctctcactaccttactaatgcttccttgcattggctttgccatgctgcttatggatctttccggaagaaggtttttgctgctaggcacaattccaatcttgatagcatctctagttatcctggttgtgtccaatctaattgatttgggtacactagcccatgctttgctctccaccgtcagtgttatcgtctacttctgctgcttcgttatgggatttggtcccatccccaacattttatgtgcagagatctttccaaccagggttcgtggcctctgtattgccatttgtgcctttacattctggatcggagatatcatcgtcacctacagccttcctgtgatgctgaatgctattggactggcgggtgttttcagcatatatgcagtcgtatgcttgatttcctttgtgttcgtcttccttaaggtccctgagacaaaggggatgccccttgaggttattaccgaattctttgcagttggtgcgaagcaagcggctgcaaaagcctaatttctttggtacctttgtgtgcaactattgcactgtaagttagaaacttgaaggggtttcaccaagaagctcggagaattactttggatttgtgtaaatgttaagggaacgaacatctgctcatgctcctcaaacggtaaaaaagagtccctcaatggcaaataggagtcgttaagttgtcaatgtcatttaccatatgttttacctatttgtactgtattataagtcaagctattcaacgctggttgttgctagaaatctttagaacaaagatgataatgatctgatctgatgttataatattcaaatctcaaataaagaaaatatcgtttctc

SEQ ID NO: 9363 - DNA, 1189 bp, Zea mays
ctcctttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatctgcaatgtgttaatcaccatttccgctg

SEQ ID NO: 9364 - DNA, 1163 bp, Zea mays
aacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 9365 - DNA, 1218 bp, Zea mays
cgatcccgtcaccgctcacctccttctccaaacactgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattattacaagtaaagggctgtccgcaatgctggataagtacaggaacgttgagttcggcagatgccctcgagtgaattgcagcggccaaccatgccttcctgttgggcaatcggatgttcctcgttcaagtacggtgaagatttactgccctagatgtgaagacatctacactccaagatccaaatatctaagcaacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttctttagcctagtgaatcaatccatatttttttacgatcatacgtattatggctttaatggtttaacaaccatctatatttttgttggcacggttcatattcgttttttactctgattgttt

SEQ ID NO: 9366 - DNA, 1739 bp, Zea mays
gctgtaatctatctccttgcagtaagcaagggcagcgagagtacgacgacgacggcccagcaacttcctcgaacagagaaaaaaaaaagaacagcacctaacctagggaagattgacatggcggagaacaacgtcgtggccacgtactactacccgacggcagcgccggcggccatggaggtctgcggcgcggagctcggccagggcaagcccgacaagtgcttcgacgacgatggccgccccaagcgcaatgggacgatgtggacggcgagcgcgcacatcatcacggcggtgatcggctccggggtgctctcgctggggtgggccatcgcgcagctcggctgggtggccggacccgtcgtcatgctgctcttctcgctcgtcacctactacacctcgtcgctgctcgcagactgctaccgctccggcgaccccagcaccggcaagcggaactacacctacatggacgccgtcaacgcgaacctcagtggcatcaaggtccagatctgcgggttcctgcagtacgccaacatcgtgggcgtggccatcggctacaccatcgctgcctccattagcatgctcgcgatcaggagggccaactgcttccaccagaagggacacggcaacccctgcaagatctccagcacgccctacatgatcatcttcggcgtggcggagatcttcttctcgcagatcccggacttcgaccagatctcctggctctccatcctcgccgccgtcatgtccttcacctactcctccattgggctcggcctgggcgtcgtccaagtcatcgcgaacagaggcgtgcagggcagcctgaccggcatcaccatcggcgtggtgaccccgatggacaaggtgtggcgcagcctccaggcgttcggcgacgtcgccttcgcctactcctactccctcatcctgatcgagatccaggacaccatccgggcgccgccgccgtcggagtcgacggtgatgaagcgcgccacggtggtgagcgtggcggtcaccacgctcttctacatgctgtgcggctgcatggggtacgcggcgttcggcgacggcgcgcccgggaacctcctcacgggcttcggcttctacgagcccttctggctcctggacgtggccaacgccgccatcgtggtccacctggtcggcgcctaccaggtctactgccagccgctgttcgccttcgtggagaagtgggccgcgcagcggtggccggactcggcgtacatcaccggggaggtcgaggtcccgctcccgctcccggcgagccggcggcggtgctgcaaggtgaacctgttccgggcgacgtggcggacggcgttcgtcgtggccacgacggtcgtgtccatgctgctgcccttcttcaacgacgtggtgggcttcctgggcgcgctcggcttctggccgctcaccgtctacttccccgtcgagatgtacgtggtgcagaagaaggtgccgcggtggagctcccggtgggtgtgcctgcagatgctcagcctcggctgcctcgtcatctccatcgccgccgcagccgggtccatcgccggcatcgcgtccgacctcaaagtctaccgcccgttcaagtcctactgatcagattcacggcctacgggagacgcagcagcatgtggtatataggcatatactagcaaccatgttcgtgagttgcaactcataagtacttaaatcagactctgcatcattgctaaacgcgagtttttttaacttgt

SEQ ID NO: 9367 - DNA, 1483 bp, Zea mays
ctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttttgtgctgctgtggttacatcgttgcccttctaccttacatagttgtgacggcaattgtttcattttggttgaaggtgaaagaatcgagtgggaagggtgaactgtggtaatctaaatcttttctcgc

SEQ ID NO: 9368 - DNA, 1830 bp, Zea mays
ctctctttccccggcacctgtcacgggaggaggatggacaagagcggcggcgaggcggcggcggcggcagcagcagcagacgacgtcgagcggcgggggggcgactacgagcaagacgagcacgagcggagaggtctgttcccgccctgtcccggtgcatccatgtactcttgtccccacgtttcgccggtccgttgaacccctctccggtcccttgctcgtcgtcccactcccagggacggtgtggacggcgacggcgcacattgtgacggcggtgatcggctccggcgtgctggcgctggcctggagcgtggcgcagctgggctgggtcgcggggcccctcgcgctcgccggcttcgcgtgcgtcacctactacacctccacgctgctcgccggcgcctaccgcgcgccgcaccccgtcaccggccacaggaaccgcacctacatggacgccgtcagatcgtacctcagtacgcctacgcctacgcgacgcacggctccacgtccgtccgtctcgtcttagctaactgaccgcggtgccctgaacatgcgtacgtcgtcgcaggtcccagggaggtgttcatgtgcggggtcgcgcagtacgtgaacctgtggggcaccatggtcgggtacaccatcacggcgaccataagcatggccgcgatcaggcaggccgactgcctccgccgggacggcgccggcgccggcgcgcgctgcgacgcgccagggaccgtgctgatgctggcgttcagcgtggtccaggtggtgctgtcccagttcccgggcctggagcacatcacctggctgtccgtcgtcgcggcggccatgtcgttcgcctactccttcgccggcctcggcctctccgtagggcactgggtgtctcgtggcggcggcggcctcgggggcagggttgcaggtgccgccgcggcatcctccaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaaattgtaggctaacaggttactgtagtcatgtacaatgctctgagccgatcgtgcgttgaggtttaaaagaactgtggtgcgcgaattcgcgtcaaatatcgaaacttctcgattgtattttcagagagtatttattgaatttgatcagtaagcatc

SEQ ID NO: 9369 - DNA, 1918 bp, Zea mays
cgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcatccttggacctggagactctttctagtttcatgtagttttagaaataagcgaacggcaagagtaccaatcttaggtgacttggtgtgggttgtgtctgaaataagtgaattggattgtagaatttcagaaataagtgaattggattgtagaattt

SEQ ID NO: 9370 - DNA, 1991 bp, Zea mays
gggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 9371 - DNA, 1506 bp, Zea mays
ctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 9372 - DNA, 1757 bp, Zea mays
gcggccgcggcgcacgggcacgttctggacggccagcgcgcacatcatcacggccgtcatcggctcgggagtcctgtccctggcctgggccatcgcgcagctggggtgggtggccggccccgccgccatgctgctcttcgccttcgtcacctactacaccgccacgctgctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtctcgcgggagctccgcgtggggcccctcgccctcagcgtgttccgcctcacgtggcggtcggcgttcgtgtgcgtcaccaccgtcgtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggcctggcctgggtttggacgtatgtgcatgatgcattcattgcgttgcgttcaactgtggtcaacaagggagggagacagatgcagatgcagtgtgagatgtttgcatggaggcccctatagaaacaagtgaaatgtttaggcgcccttgtgcacatgctggtcgcattccttgcaagaataccaggggtggggccagaatggcatgagctgggtgttcctttctaactcttcttcttcttcttctcctcttcttctttatttacatttttcttttatgtgttttcgtctaattaaggttctggttttgtagttctaccgtgcaactcattgtaccggaaaagaatatatgaacaggaaatcccatatgatctttgccatcttt

SEQ ID NO: 9373 - DNA, 1904 bp, Zea mays
atgcgctgaagacagtctgaggcgctgcgggcagtctaacagcaccccctcctcgctcgcactccgttcgtctgacatctcctcccgtcctttcctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccgtcaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccatagctttgcgtgccggaggtgctatgtggtgtttctgtgcgtttggttgcaatgataggacgggatgagatgagaccctcaaattaggttgtttggttctgggtcaaagattgagacaagaatatcctagtattgtttc

SEQ ID NO: 9374 - DNA, 1561 bp, Zea mays
gaaaaattctttgttacgtttttgttgatagcgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactatggggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgtcgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttggaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtgtttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcaggtaacctcttgcttattgtggcttcaaaatattttattcagcatggtcttattacagattctcagttctctttgtgttactagctttttataaatggtttcttttgggtctaatgtatgtcctgtaagagtgttactttgtatgcaaaacccttggcaccatagttattaaggcggtaaggcgacataatgcgatcgcc

SEQ ID NO: 9375 - DNA, 1988 bp, Zea mays
ccagtttttctcctctcgcccccgttccccgtcccgactcccgacccaacccatatcagaggttccgtccgttggtggcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccgcgcctcctccgagtacagcgccagcgccgtggccgacgactcgcccaggaagcccacgcagccgcccgccaccacggacgcccacgcgccgccaccgccgcccgccaccgccgcagccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatctccaagcgcaagctcatcaccagggaggacgtcgacgacgtgcgccgcgagatccagatcatgcaccacctctccggccacaccaacgtcgtcgccatcaagggcgcctacgaggaccagctctacgtccacatcgtcatggagctctgcgccgggggcgagctcttcgaccggatcatacagcgcggccactacagcgagcgcaaggccgccgagctcaccaggatcatcgtcggcgtcgtcgaggcctgccactcgctcggggtcatgcaccgcgacctcaagcccgagaacttcctgctcgtcaacaaggacgacgacctctcgctcaaggccatcgatttcggactctctgtcttcttcaagcctggtcaagttttcaccgatgttgttggtagcccatattatgtagctccagaagttttgttgaaaaattatggaccagcagctgatgtatggacagctggcgtcattctttacattctactaagtggcgtgcctccgttttgggcagaaacacaacaaggaatatttgatgctgtattgaaaggtgtcattgattttgattctgatccgtggcctgtcatatctgatagtgcaaaagatcttataagacggatgctgaatcctcgctctgccaagcgcttaacagcacatgaagttctatgccatccatggattcgtgatcatggagtagctcctgaccgtccactggatccagctgtcttatctcgcattaagcaattctctgcaatgaataagttgaagaaaatggctttgcgagtaatagctgagagcctatcagaagaggaaattgcggggttgaaggaaatgttccagaccatggacactgacaacagtggcgcaattacctacgatgaactaaaagaaggattgagaaaatatggttccacactgaaggacactgagattcgtgatcttatggatgcagctgatatcgacaacaatggaacaattgactacattgaattcatcgctgcaactttgcatctcaataagctggagcgcgaagaacatctcgtggcggccttttcatatttcgacaaagatggtagtggctatatcacagtggatgaactacagcaagcttgcaaagagcataacatgccggatgcttttcttgatgatgtcatcaacgaagctgatcaggataacgatggccgcattgactatggagagtttgttgccatgatgaccaagggcaatatgggagtcggtcgacggacaatgagaaacagcttgaatatcagcatgagggacgcacctggtgcattctgaaacttaacacgatgtacagcttgtggcctagtcacttcggccctgtttgtttcggcttctggcagcttctggccaccaaaagctgctgcggactgccaaacgctcagcttttcagccagcttctataaaattcgttgcggc

SEQ ID NO: 9376 - DNA, 2699 bp, Zea mays
ggacgaactcgtcactggtgtgggccgtggctgtacgccgcagagtgaagcgagacgagacgacgatgcgcaagtgggcgctctcctccgcgctcctccttctcttcctcctcaccaccctccccgacccagctaagaagctacaggtgaatgcggaagagagcagcgatgacttagctaacccacccaaggtagaggagaagcttggtgctgtccctcatggcctgtccaccgactctgaggttgcccagagggaagctgagtctatctctaggaagactcttaggagctccgccgagaagtttgagttccaggctgaggtgtccagactcatggacatcatcatcaactcactctacagcaacaaggatatcttcctgagggagctcatatccaatgcctctgatgcattggataagatcaggttcctttcccttactgataaggaagttctgggtgaaggtgacactgcaaagcttgagattcagattaagttggacaaagagaagaaaatcctctccattcgggataggggtattggtatgaccaaggaggatcttattaataaccttggaaccattgctaagtctggcacttcagcttttgtcgaaaagatgcagtctggaggtgacctcaatcttattggacagtttggtgttggcttctactcggtgtacttggttgctgactatgtcgaagtggtcagcaagcacaatgatgataaacaatatgtttgggaatcaaaagctgatggatcgtttgctatctccgaggatacatggaatgaaccccttggccgtggaaccgagataagattacatctgcgagatgaggccaaggagtacttggaagaggataagcttaaggatttggttaagaagtactctgagttcatcaacttccctatctatttgtggtcaaccaaggaggttgatgttgaagtgccagctgatgaggatgagacaagtgaagaagaggattcgtccccagaaactacagaagaagagacagaagaagatgaagagaaagagaaaaagcctaagacgaagacgataaaggagactacttctgaatgggaacttctgaatgatatgaaggctgtatggcttcgcagcccgaaggaggttactgatgaggaatactcgaagttttaccactcactagccaaggacttcggtgatgacaagcctatgggttggagccacttcactgctgaaggagatgttgagttcaaagctttgctcttcattccaccgaaggctccgcatgatctctatgagagttactacaacagcaacaagtcaaacctcaagttgtatgttagaagagtgttcatctctgatgaatttgatgaccttcttccgaagtatctcagctttttgaggggtattgttgactcagacacactgccgctgaatgtgtcacgagaaatgctccaacaacatagcagtctgaagactatcaagaagaagctgatccgcaaagctcttgacatgattaggaaacttgctgaagaagaccctgatgagtacagcaacaaggataagacagatgaagagaaaaatgagatggaggagaagaagggccagtacgccaagttctggaatgagtttggcaaatcaatcaagctgggtatcattgaagacgcaactaacaggaaccgccttgcgaagcttcttagatttgaaagtaccaagtcggatggcaaacttgcctcccttgacgagtacatttcaaggatgaagccagggcagaaagacatcttctacctcacgggaagcagcaaagatcagctggagaagtctccgttcctggagaggctaaccaagaagaactacgaggtcatcttcttcaccgaccctatggacgagtacctgatgcagtacctgatggactacgaggacaggaagttccagaacgtgtccaaggagggcctgaagctgggcaaggactcgaggctcaaggacctcaaggagtcgttcaaggagctgacggagtggtggaagaaggccctggagagcgagagcgtggactcggtgaaggtcagcagccggctgcacgacaccccctgcgtcgtcgtcacctccaagtacgggtggagcgccaacatggagaagatcatgcaggcgcagacgctgtcggactcgagcaagcaggcgtacatgcgcggcaagagggtgctggagatcaaccccaggcaccccatcatcaaggagctccgcgacaaggtcgcccaggacaacgagagcgaggagctgaagcagacggcgaggctggtgtaccagacggcccttatggagagcgggttcaacctccccgaccccaaggagttcgcgtccagcatctacaagtcggtgcacaagagcctggacctgagccccgacgcggccgtggaggaggaggacgaggccgaggagcagccggaggtggaagagaaggagccggcggccaaggaggggtcggagccgtccttcgacaaggacgagctgtagtcggcgtgctgtggtctcgtctcgtcttcgggatctgttttgaagtctagctgtagctcccgtttagttgagatatcggggagcccactcactgccagctttgtgtttaggaacgtgatacgggatctttttttttttgttgcctgtctttgtacttgtacaaacctcagttcagtgactcggtctaattaccggctccgattagtg

SEQ ID NO: 9377 - DNA, 2743 bp, Zea mays
ggtagattcggagcggctcttggcttgcagtccagacgcccttcacccctgatctggaccggagggagcggctccttccgtcagttgttcttgctttgcctgggcctcttccgcctgcttcgtgttcttcacaggagccggtgacctcggacgatatcttggaggacaagatgtcgggggctgttcttgtcgccatagtcgcctccatcggcaatctattgcaggggtgggacaatgccaccatcgcagctgctgttctgtatataaagaaggaatttcaattgcaaaatgagcccactgtggagggactaattgtgtcaatgtcacttatcggcgccaccatcgttactacattctccgggccattatcagactcgattggccgacgccctatgcttattctctcttcaattctgtacttcttcagcggcctcatcatgctatggtctcctaatgtctatgtcctgctgttggcacgcttcgtagatggatttggtattggcttggctgtcacgcttgtgcctttgtacatttcagaaatagccccttcggagattagaggtttgctgaatacactaccacaattcagtggatcaggaggaatgttcttgtcatactgcatggtgtttgggatgtccctgtcgccatcacccgattggagaattatgcttggtgtgctcgcgataccttcattgttcttctttggtttgacaatattttatcttcctgaatctccaagatggctcgttagcaaaggtcggatggcagaggcaaaaaaggtgttgcaaaagttacgggggaaagacgatgtctcaggtgaattgtcccttcttctcgaagggttggaggttggaggagacacttccattgaagagtacatcattggacctgccaccgaggcagccgatgatcttgttactgacggtgataaggaacaaatcacactttatgggcctgaagaaggccagtcatggattgctcgaccttccaagggacccagcatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcagcatgccaaaaatgagcagtgggatgaagagaatcttcatagggatgacgaggagtacgcatctgatggtgcaggaggtgactatgaggacaatctccatagcccattgctgtccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtagaaaggaaggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctctcactaccttactaatgcttccttgcattggctttgccatgctgcttatggatctttccggaagaaggtttttgctgctaggcacaattccaatcttgatagcatctctagttatcctggttgtgtccaatctaattgatttgggtacactagcccatgctttgctctccaccgtcagtgttatcgtctacttctgctgcttcgttatgggatttggtcccatccccaacattttatgtgcagagatctttccaaccagggttcgtggcctctgtattgccatttgtgcctttacattctggatcggagatatcatcgtcacctacagccttcctgtgatgctgaatgctattggactggcgggtgttttcagcatatatgcagtcgtatgcttgatttcctttgtgttcgtcttccttaaggtccctgagacaaaggggatgccccttgaggttattaccgaattctttgcagttggtgcgaagcaagcggctgcaaaagcctaatttctttggtacctttgtgtgcaactattgcactgtaagttagaaacttgaaggggtttcaccaagaagctcggagaattactttggatttgtgtaaatgttaagggaacgaacatctgctcatgctcctcaaacggtaaaaaagagtccctcaatggcaaataggagtcgttaagttgtcaatgtcatttaccatatgttttacctatttgtactgtattataagtcaagctattcaacgctggttgttgctagaaatctttagaacaaagatgataatgatctgatctgatgttataatattcaaatctcaaataaagaaaatatcgtttctc

SEQ ID NO: 9378 - DNA, 1531 bp, Zea mays
gcgcaagccgcgccgtggtttgcttgcccacaggcggccaaaccgcaccctccttcccgctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattcc

SEQ ID NO: 9379 - DNA, 1220 bp, Zea mays
gccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggttt

SEQ ID NO: 9380 - DNA, 933 bp, Zea mays
caacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcct

SEQ ID NO: 9381 - DNA, 1566 bp, Zea mays
caagtgtaaagagtgcgaagaagcagtagcaaaaggattccattctcgtgttcttggagtggtccatcgatcgagctccgtgaaagagagagagagagagcaagcaatggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaat

SEQ ID NO: 9382 - DNA, 1330 bp, Zea mays
gcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgacctgctaaatgtgcttgacgttgcattgacatttgtatgagctgagtcgctcattcctttttatgaacgcctgtactcttctcattctctccctgcatttttgtcattcagctggatatttcgaatctggtgtgttttgagatgtattaaagaacgtcaaatagattaccgccttggtctctgtccattgaaagtaaatatccgtcatatgttt

SEQ ID NO: 9383 - DNA, 2049 bp, Zea mays
gccaaagaattccctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 9384 - DNA, 3267 bp, Zea mays
caccgagcacaactacctttccggctttgtttcctctctctcctctccactttcttctccccctcacggagtgcaagtgcgagtgggagagtgagcggcggcggcagcggcagcgcagcggcagtacagtagccacggcccctgtcgccgcgtggtgtgccgtgcccgtgccccctctcagcctctctctcccccttccctaccaggctacccacccaaaaccacagagaaaagcaggcctgggcaccaccaccgctgcctcgccccgagccaagaggaagccccaccccaaatgccttcctcttccccctgctaccgccacagcttcctcttcctggcccttctctcggcgtgcttctcgacaccgggggcagcggacggcaccgggggagccggcgacggcggggatgccgcggcaatgcaggcgctgcggcgggacctggcgccgccaggctggggcccgggtgcggaccactgcgcgtggcgcggcgtcacctgcgcagccgcgggggccggtggcgtggtcaccgcgatcgagctgccgcgccgggggctccgtggggacttcgccgccgccgccgcactccgcgcgctggcgcgcctcgacctctccgccaactcgctcagcggcggcctctcgccggcgttcggcgcgctcacccgcctcgagtacctcgacctctcaatgaacgcgctcaccggcgccgtgccggccgcgctcgctggcgcgtccgcgctccggttcctgaacctctccaacaacgcgctctccggcgccatccccgacgatctcaggggcctcaagaagctccaggagctgcagatttcgggcaacaacctcaccggctccctccccggctggctcgcgcggctcccgggcttgcgcgtgctgtccgcctacgagaacgcgctctccggcccgatcccgccggggctcgggctctcgtcggagctccaggttctcaacctccactccaacgccctcgaggggagcatccccagcagcctcttcgagctcggcaacctgcaagttctcatcctcaccatgaaccggctcaacggcaccatccccgacaccatcggccggtgccgcggcctctccaacgtccgcatcggcgacaacctcctctccggcgccatcccggcgtcgatcggggacgccaccggcctcacgtacttcgaggccaacacaaacgacctgtccggcgggatccccacgcagttcgcgcggtgcgccaacctgactctgctcaatctggcgtacaaccgccttgccggcgaggtgccggatgttctcggagagctcaggagcctgcaggagctcatcgtgtctggcaacggcctctgcggcgagttcccgaaatccatcctgcggtgcaggaacctgagcaagctggacttgagctacaatgcgttccgcggtggcctgccggagagcatctgcaacggctcacggatgcagttccttttgctcgaccacaatgagttctctggaggcattccagcaggaatcgggggctgtacccggctgctcgagctgcatctcggtagcaacaacctcagtggtgaaattccagctgagataggcaaggtgaaaagcctgcagattgtgctgaaccttagcttcaatcactttactgggccgctgccccacgagcttgggcggcttgataagctggtcatgctggacttgtcaagcaatgagatgtccggtcagatcccaagtgatatgagagggatgctgagcttgattgaggtcaatttgtcaaacaaccggttcagtggcgccataccggttttcggaccgttccagaagagtgccgcctccagcttctccggcaacgccaagctgtgcggcaacccactgaatgtggactgtggatcaatttatggctccaattatagaatggaccacagggggatatcttacagggtggctttggcagttgttggttcctgtgtgctcatcttctcattggtgtcattggtggtggcgttgttcatgtggcgtgagaagcaggagaaggaggaagatgcgaagaagaaggccgaggcaggggaggtggtggtggcagccccgcaggtcgtggcctcatccgtgttcatcgatagcatgcagcaggccattgatttccagagctgcatgaaggcgacactcaaagatgcgaatgaagtgagcaacggaacattcagcacttcctacaaagctgtcatgccgtctggcatggtggtgtgtgtcaagaaactgaagtctgtcgaccgtgcggtcatccaccagcagacgaagatgatccgagagctcgagcgtcttgcccacatcaaccacaagaacctggtccggcccgttgggtatgtcatctatgacgacgtcgcgctgctgctgcaccaacatatgctgaatggaaccctgcttcagttgctgcacagcagcggcggcgatactgacggcaagaagcagaaacctgactggccgaggctgctctcgattgccattgatgtcgccgaagggctcgcattcctccatcaggttgccaccattcaccttgacatctgttcagggaacgtcttccttgactcgcactacaatgcgcttctcggcgaagtcgaaatctccaagctactggacccttcaaagggcacagccagcatcagcacggttgctggctcatttggttacattcctccagagtatgcctacacgatgcaggtgacggtgcccggcaatgtgtacagctacggcgtggtcctgctggagatcctgacatccaagctacccgtggacgacgtgttcggcgagggcgtggacctcgtcaagtgggtgcacaccgcaccagcaaggggtgagacgccagagcagatcatggacccccggctgagcaccgtgtcgttcgcgtggcgcaggcagatgctcgccgtgctcaaggtcgcgatgctgtgcacggagcgcgccccggccaagcgacccaggatgaggaaggtggtggagatgctgcaagaggccaagaacagctgagttgatgtgtttctctgctgaatcctgaatgctgcggttgcctgcttggaagtcgagccgagcctctagaaaaaaatctggtcattggttcggttcgagtatgaaatccatccagtagtgtttaattctctgtatatattcggtaattagtaccccgattatgcgccatttatggatattggatcttgaagcatcaaactagaaatcttgcttgcagtgctgctacctgcaacttgcaagtgaagaaatgtctc

SEQ ID NO: 9385 - DNA, 1360 bp, Zea mays
agggccacccattggtgttatgcctgtcagcgcccaattcgtcttcgcgggcaggatatcatatgtcccaactgcagtgatggttttatccaagaaatcagtgagatgggtggcgtactgaacacttatgggctaactgaaccggactttgaagagcgccaggccagaagatttggaatgatggatgccatatcttccctcatgcggcaacggctgtcagaaataggaagggatagtttgtttgatattcacggtagacaagggacaggtactgaatatggaaggaggtcaactgctattcctacgctggtatttggtggcatcccttctcctgcagttggtagcagtgatatcaatgttgtcatcagggaaggccgcagagctggcgctgcccgtccgaatttcagtagcttagttgttggtcccagtctggaagctctatttgagcagctactactccagaacaaccgtcaaggcccaccacctgctccacagtcagctattgactccatgcctgtggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccatcacagcgatcaggcagtagtaccagcagcgcccgtgtgccttcagcatactacaacgaaacagcttgccctcctgcggtcgccagggcagatttcgatcctgtgccttcagcatactacaacgaaacagcaactgatcctcctgcggtcaccagagcagatttcgatcctgctccaggaaactacggcagcgaaagccaggaaagtcacgtccccttctcctttctctggccatttggcccgtcgagttcttaccaatatgaagaaaatgttgatgaacctgcagtatacgatccaaaccagatagcatattctgcgtggcactatgaccactgactgaaaccctgagttaaaatcaagatatctgcaattcgtgccttgagctctcagctttggtgaggcaaagggctgcttgccgtataaaaaatggatggttattgtgttcagtgcatacccttgctacgcatgtccgttgtggagatatcagctgtgtatagaactgggcgcaataaactctgctgtaatgcccgtatatattccttttcggtatatcaagtctaaagctacataatcctgtatgtgcagtaatcggtgaactgagtgcatccagaatatcatgtcatgataaacatgattataattacatggttgtctttttagactg

SEQ ID NO: 9386 - DNA, 1467 bp, Zea mays
ccgccgcccgcccgggtcgcatcgcatcgcctggtcggccggggactcggggcaggcgagcgacactagctataaaagacctcccgccgcctgcgactgggccgtgtgcaagcaaattaaagcgcaaggccgatccgagggtggactgtggagggccggccatggtgatgatgatgcggtcgtgcctcggcggtggcctgctgccggtggcggtcatgctctgcctcaacgtggtggcggcggtcatggtatcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgccacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccagcagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctcctccaaaggttgccgaagaagaccctgctgacaaagagcagcagcaagtgcagcacaactgaagacggacagcatcctctgactgttggtcgtttggttgtaacagtgccagcaataagatccctctgcctccttttcttttcttttggtgtctcaggggggtgggcaatgttccttccttctcagatcgatcaccaacaaagtgtttagattctaatccaaaacagtagaatggtcttaaatacagtactcctgcttactgatgat

SEQ ID NO: 9387 - DNA, 1287 bp, Zea mays
gggaaaaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggct

SEQ ID NO: 9388 - DNA, 717 bp, Zea mays
ccgatctgcatttcactcgttccacaccgtcgttggccggcccatagctctccccctcctggttagtgtagtgagcgcagcgacgagtgcaacggtgagagtaccgagatggctgagggaagaggcagtgcaagggccatcggcgccatggcgttcgccgttgcctgctgctactgctgcgtcgccatcgccgacgcagccaccacctactacgtcggggacagcaacggctggtccttcagcagccccagctggcccaacggcaagcacttccgcgccggagacactctcgtgttcaggtacatcccctggatccacaacgtggtggccgtggacgaggacgggtacaacggctgcacgacgccgccggggtcgcggacctacacgtccggcgccgacagcgtgacgctcgccaggggggacaacttcttcatctgcacccggttcggccactgcaacctcggcatgaagctcgtcgtctatgccgcgtgatctgtcagagctagcgactggtggtggtattgttgactgggtgcgctcaatgatcggctgtgcttgctctcgagcgaactggtctgtttgatttgtgctatttcgtgtaggctcagtcagtcgcttggttctaatccgtaacggcttctactacttttacaatgttgttgtaacaatacaaacatccagctttaattgaagctaacggatatcgcatgtttgaac

SEQ ID NO: 9389 - DNA, 1331 bp, Zea mays
ccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccaggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctcttcgttttgttctgctgaatacttgcagatccttactgttctgataaaacttactgactcccaaatctgtgccagacaaaacgtgtttcaggaacataatacatctgatagcacttgtt

SEQ ID NO: 9390 - DNA, 1324 bp, Zea mays
gtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 9391 - DNA, 2043 bp, Zea mays
catcgacatcctctcacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttcaatgacgagccaaccaaaccagctggattctgaactttggtttcgagtgatctggccacactgagccacgaccgatctgataaaagataagcttgatagacataggtgcaacgtagaagattaattgtgatgttagttcaaaatgtcaatgattttactgggaggcggtctgtaatgtatgatcttacatctcttgtaccttcttacatctctcgtacctcccagcggaagaatatactcgcagaaaagttttct

SEQ ID NO: 9392 - DNA, 1927 bp, Zea mays
gctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccggcgtcttcgtctccgcggcgggcgctgtcggagcggatggttgcgacggtggagtccggcgtggcggtcgggtccggcgagtacctgatcgacgtctacgtcggcacgccaccgcggcgtttccggatgatcatggacaccggcagcgacctcaactggctgcagtgcgcgccgtgcctggactgcttcgagcagcgtggcccggtgttcgaccccgccgcgtcctcctcctaccgcaacgtcacctgcggcgaccagcgctgcggcctcgtggcgccgcccgaggcgccgagggcgtgccgccgccccgcggaggactcctgtccgtactactactggtacggggaccagtccaacactaccggcgacctggccctggagtccttcacggtcaacctcacggccccgggcgcgtcccgccgtgtggacggcgtagtgttcgggtgcgggcaccgaaaccgcggcctcttccacggcgcggcggggctgctggggctcggccggggcccgctgtcgttcgcgtcccagctccgcgccgtgtacgggcacaccttctcgtactgcctggtggagcacggcagcgacgccggcagcaaggtggtgttcggggaggactacttggtgctggcgcatccgcagctcaagtacacggcgttcgcgcccacgtcgtcgccggcggacacattctattacgtgaagctcaagggcgtgctggtgggcggcgacctgctgaacatcagctcggacacgtgggacgtgggcaaggacgggtccggcggcacgatcatcgactccggcacgacgctgagctacttcgtggagccggcgtaccaggtgatccggcaagcgttcgtcgatctcatgagcaggctgtaccctctgatcccggacttcccggtgctgaacccgtgctacaacgtctctggcgtggagcgaccggaggtgccggagctgtcgctgctgttcgccgacggtgccgtgtgggacttccccgcggagaactacttcgtccggctggacccggacggcatcatgtgcctggcggtccggggcaccccgcgcaccggcatgtccatcatcggtaacttccagcagcagaacttccacgtcgtgtacgacctgcagaacaaccggctgggcttcgcgccgcggcggtgcgccgaggtgtagtgtatagccgccggcgaggcctcctgagactgagaggacgaacaattcgaactcagtcctcgcttgattgattggattgggaggcaaattgggtgtagaaatttttggttgggaaggacggtggcacgtacgcaagctctaatacatagttttttttgttgcatttatctccaaggagagaaggttagggatattttattaaggaccgtgcaggtgggttgtaacgggaaaatactgattttgttcccatgtacaatacccgtttcttcactcaaattttagaaattgtaagttgtagattaagaatgagagtgcacac

SEQ ID NO: 9393 - DNA, 1321 bp, Zea mays
ctcaagcctgccctgccctgccttgttaagcaaagcaacccagctgcgagacacgagagctagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccgcaagctgtcggagaggctgctggacctgctgtgcgagaacctgggcctggagcccgggtacctgaaggcggccttcgcggggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtgatcaccaacgggcggtacaagagcgtcatgcaccgcgtgctaacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagagaagactgccttccgctgcaggcttccttcgtggcgtcaagccttgaggcttgaacgaacaacgtacgtccatgtgcttatagtggcacagttatgtgtgtaactaccgatcgtggaacggcctaatgtatttcggttgcctcagatcgatctatatgtgcgtatacattatgtactgaaaagtgtgtagcgtctggttaatgtatgagcagtgtgtatgtgaccgggacccggtgtgtagttgctattactaccatatccggtgaatgatcaaaccttttggtgtattaac

SEQ ID NO: 9394 - DNA, 2042 bp, Zea mays
aaagaattccctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcg

SEQ ID NO: 9395 - DNA, 1789 bp, Zea mays
gctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgtctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaggtatttgctgtaatcctgtccctttacgttcgtgcactgcaatgagaataaaaaaaaataagtgtcgttcacgg

SEQ ID NO: 9396 - DNA, 1674 bp, Zea mays
gaattcccgggtcgacccacgcgtccgcccacgcgtccgcccacgcgtccgcccacgcgtccgcccacgcgtccgctcctctctttccccggcacctgtcacgggaggaggatggacaagagcggcggcgaggcggcggcggcggcagcagcagcagacgacgtcgagcggcgggggggcgactacgagcaagacgagcacgagcggagagggacggtgtggacggcgacggcgcacattgtgacggcggtgatcggctccggcgtgctggcgctggcctggagcgtggcgcagctgggctgggtcgcggggcccctcgcgctcgccggcttcgcgtgcgtcacctactacacctccacgctgctcgccggcgcctaccgcgcgccgcaccccgtcaccggccacaggaaccgcacctacatggacgccgtcagatcgtacctcagtcccagggaggtgttcatgtgcggggtcgcgcagtacgtgaacctgtggggcaccatggtcgggtacaccatcacggcgaccataagcatggccgcgatcaggcaggccgactgcctccgccgggacggcgccggcgccggcgcgcgctgcgacgcgccagggaccgtgctgatgctggcgttcagcgtggtccaggtggtgctgtcccagttcccgggcctggagcacatcacctggctgtccgtcgtcgcggcggccatgtcgttcgcctactccttcgccggcctcggcctctccgtagggcactgggtgtctcgtggcggcggcggcctcgggggcagggttgcaggtgccgccgcggcatcctccaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaaattgtaggctaacaggttactgtagtcatgtacaatgctctgagccgatcgtgcgttgaggtttaaaagaactgtggtgcgcgaaaaaaaaaaaaaaaaaaaaaaaaaaaaaagggcggc

SEQ ID NO: 9397 - DNA, 3259 bp, Zea mays
cccattctctcacacccaacacccagctatcacaccctgatccccgaggccgcgcgtcggggtgaggaggaggggccatgatggagtcggcggcggcccagtcctgcgcggcgtgcggggacgacgcgcgcgctgcctgccgcgcgtgcagctacgcgctctgcagggcgtgcctcgacgaggacgccgccgagggccgcaccacatgcgcgcgctgcggaggggactacgccgctatcaacccagcgcgcgccagcgagggaaccgaggcggaggaggaggtggtggagaaccaccacaccgccggtggcctgcgtgagagggtcaccatgggcagccacctcaatgatcgccaggatgaagtaagccacgccaggaccatgagcagcttgtcgggaattggtagtgaattgaatgatgaatctggtaagcccatctggaagaacagggtggagagttggaaggaaaagaagaatgagaagaaagcctcggccaaaaagactgcagctaaagcacagcctccgcctgtcgaagaacagatcatggatgaaaaagacttgacagatgcatatgagccactctcccgggtcatcccaatatcaaagaacaagctcacaccttacagagcagtgatcattatgcggttaattgttcttgggctcttctttcactaccgtatcaccaatcctgttaacagtgcctttggtctctggatgacatcagttatatgtgagatctggtttggtttctcctggatattggatcaattcccgaagtggtatcctatcaatcgtgagacttatgttgataggctgattgcacgatatggagatggtgaagaatctgggttagcacctgtagatttctttgtcagtacagtggatccattgaaagagcctccactaatcactgcaaacactgtgctgtctattcttgctgtggactatcccgttgagaagatctcatgctatgtatctgatgatggttctgctatgctcacatttgaatcgctcgcagagactgcagaatatgctagaaagtgggtgccgttttgcaagaagtacgccattgagccacgagctcctgagttctacttctcacagaaaattgactacttgaaggacaagatacacccatcttttgtcaaggagcgtagggctatgaagagagactatgaagagtacaaggtgaggataaatgctttggttgccaaggctcaaaagacacctgatgaaggctggatcatgcaagacggtacaccatggcctgggaacaatcctcgtgaccaccctggcatgatccaggttttcctgggtgagactggtgcacgggactttgatggaaatgaacttcctcggttagtgtatgtgtcaagagagaaaagaccaggctaccaacaccacaagaaggcaggggctatgaatgctctggtccgagtgtctgctgttctgacaaatgccccttacattcttaatcttgattgtgatcactatgttaacaacagcaaagctgttcgtgaagcaatgtgcttcatgatggaccctactgttggcagagatgtctgctatgtacaattcccccagaggttcgatggcattgatcgcagtgatcgatatgccaataggaacgttgtgttctttgatgttaatatgaaaggacttgatggcctccaaggcccagtttatgtgggaactggttgttgtttcaataggcaagcactttatggttatgggcctccatctctgcccgcacttccaaagtcttcgatttgttcctggtgttgctgctgctgtcccaagaaaaaggttgaaagaagtgagagggaaatcaacagagactctcggcgagaagacctcgagtctgccatttttaaccttcgcgaaattgacaactacgatgagtacgagaggtccatgctcatctctcagatgagcttcgagaagtcttttgggctgtcctcggtctttattgaatcgacccttatggagaatgggggcgtccctgaatctgcaaacccatctaccctaattaaagaagccattcatgtcattagctgtggatatgaagagaaaactgaatggggaaaagagattggctggatctatggttcagttacagaggatattctgactgggtttaagatgcactgccgtggctggagatccatctactgcatgccggtgagacctgcattcaagggatcagccccaatcaatctttccgatcgtcttcaccaagttctccggtgggctcttggttctgtcgagatcttcttcagtcggcactgcccgctgtggtacggttacggtggcggccgtctgaaatggctccagaggctctcctacatcaacaccatcgtgtacccgttcacttctcttcctctcgttgcctactgttgcctgcctgccatttgcctgctcacaggaaagttcattatacctacgctgtccaacgctgcaacgatatggtttcttggcctcttcatgtccatcatcgtgacgagcgtgttggagctgcggtggagtggcatcgggatcgaggactggtggcgcaacgagcagttctgggtcatcggaggcgtgtccgcgcacctgttcgccgtgttccagggtatcctcaagatgattgccgggctggacaccaacttcacggtcacggcaaaggccacggacgacactgagttcggggagctgtacctgttcaagtggacgacggtgctgatcccgcccacaagcatcctggtgctgaacctggtgggcgtggtggctgggttctcggccgcgctcaacagcggctacgagtcctggggcccgctcttcggtaaggtgttcttcgccatgtgggtgatcatgcacctgtacccgttcctcaagggtctcatgggccgccagaaccgcacgccgaccatcgtggtgctctggtccgtcctcctcgcctccgtcttctccctcctgtgggtcaagatcgacccattcgttggaggaaccgagaccgtcaacaccaacaactgcaacacgatcatctgctgattcaccatcggtcagctgctgtcgtgccgcggcggacgtgtttctggtgttgcaaacgtgggttgcctgcctgatgcgggtctcctctgtctatctcgcatctgggcttttgccccaggatctgaagcgggtggtgtaggttagctttattttgcgtccaagtgttgattgatgttgtctgtgttatgaaaagttttggtggtgaaacctgaaatgttaaaattcggctc

SEQ ID NO: 9398 - DNA, 1087 bp, Zea mays
acgccccagcaccacccctgcctctcagtccagtcccccacccaccaccaccactcctcccctcgccgccgcccgttcccgaccgatccggccggatcgccccgccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcccgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcccgattacaagtcaactttcccaaagtggccacctgtggatcttgcaacggtggtcccgacactcgaaccgtcgggaatcgatctcctatctaagatgctgcgtctagatcccagcaagaggatcaccgcgcgcgccgccctcgagcacgactacttcagggacctcgagcacgcctagcagggatggatggatggacggatgaaccatttcccctcccctgctccctctgtaaattacggtagcagccgcgatgcttggggccggcgagtacccccgttt

SEQ ID NO: 9399 - DNA, 1797 bp, Zea mays
gaattcccgggtcgacccacgcgtccgcggacgcgtgggcggacgcgtgggcggacgcgtgggcgccgatgagctatactctttgctcactgtactagtcacacgattggctacacgacacgagctcagagctctcaggtttcccaacgccggctgctggccaatggcgcagcaccacggcagccactccctggaggtcggcggcgtcggcgccggcggcgtcgagctcgacgacgacggccacgccgcgcgcaccggcaacctatggacctgcttcgcgcacatcatcaccgccgtgatcggctgcggcgtgctggcgctctcgtggagcgtcgcgcagctgggctgggtgggcggccctgtcgccatgctctgcttcgccttcgtcacctacctctccgccttcctcctgtcccactgctacaggtcccctgcctccgatgatggctccctgaaacgccagaggaactacacctacatggacgccgtcaggacgcacctgggggagaagcgcacctggctctgcggcctgttccagtacctcaacatgtacgggaccgcaatcgcctacaccatcaccacggcgacctgtctcagggcgatcgtgagggccaactgctaccacagccagggccacagcgctccctgcggcgccggcggcgaccacctctacatgctgctcttcggggcggcccaggcggtgctgtccctcatacccaacttccacagcatggcctggctctccgccgtcgccgccgtcatgtccttcacctacgccaccatcggcctcggcctcggcctcgccaagaccatagaaaatggggcgatcaaaggaagcgtcgccggagttccgatgagcaccgcgccgcagaaagtctggcgagtcgcgcaggccatcggcgacatcgcgttcgcctacccgtacaccattgtcctactggagatacaggacacgctcaaatcgccgccaccagagagcgagacgatgcagaaggggaacgtgctcgcggtcctggccaccacgttcttctacctcgccgtggggtgcttcgggtacgccgccttcggcaacgctgcgccgggcaacctgctcaccggcttcggcttctacgagccgtactggctcatcgacttcgccaacgcctgcatcgtgctccacctgcttggtggctaccagatgttcagccagcagatcttcaccttcgcggaccggtccttggcggccaggttcccgaacagcgcgttcgtgaacaaatcctacgccgtgaaggtgcccggcgcgccggcgtcgtggagctacagcctcaacctgcagcggctgtgtttccggacggcgtacgtggcgagcaccacggggctggccctcctcttcccctacttcaacgaggtgctgggcgtgctgggcgccgtcgtcttctggcccctcgccatctacctccccgtcgagatgtactgcgtccagcgcggggtcctgccgtggacgcggacgtgggtcgcgcttcaggcattcagcgtcgtctgcttcgtcgtcggcaccttcgccttcgtcggctccgtcgagggagtcatccgcaagaggctcggctagttgtggtattagcgccttttctgtcgtcaaccatgtcatgaatggtggaagtgtgtaaagagagtgtactgtatctaagttttttttatttccctgtgttcgcttagccatgagcccatgaccatgatgattgatgaatatatctacccgtgcgtgtttagatccaaaaaaaaaaaaaaaaaaaaaaaaaaaaaaaaaagggcggccgc

SEQ ID NO: 9400 - DNA, 1308 bp, Zea mays
gtgccgccgaacaccctcacaagagtcggcctctcgatttctcagtccagcctcagcagtccccttccctccctccatcaggtgttgcctcccgcagatccaaatcggaattcggtccttcgtccccaaaccaccaatccgggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcg

SEQ ID NO: 9401 - DNA, 1688 bp, Zea mays
cctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccgtcaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccatagctttgcgtgccgg

SEQ ID NO: 9402 - DNA, 844 bp, Zea mays
ccaactcgcactcgcccaacctcgaatgccaagctagcaagagaggcctcgatcgcagaacccagcggcaaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtagtagtgtagtactagctagccagtttgcctgtgcactagccactagccaatttgcgacttcgcaatgcaaatcaagaaatcgacgggcaaatatttttctcctgc

SEQ ID NO: 9403 - DNA, 2220 bp, Zea mays
ttaagataaagtcgaagaccatagatgttatgccaaccaaggcaactctcaggtcagacaaccaggagatgtcgaaggaagagctcaggagacagcaccaggctgaacttgctcgccagaagaatgaagagactgctagaaggcttgctggggttggtactggatctggtgacggacgtggtcctgcgagggcttcaaatgagcttgttgcatataagaatgttaatgatgtaccatttgtaagagatttggtgatccaagtagatcagaagaatgaagctgtcctcttacctatttatggtagtatggttcctttccatgtttctactgtcaagagtgtgacaagtcaccaggacaaccgcacctgcactatccgtatcttcttcaatgtgcctggcatgccattctcaaatgatagcaagtttaattctcaaggtgctatctatctgaaagaaattacattccgctcaaaagatccacggcatagcagtgaagttgttcagcagatcaaaacattgaggaggcaagtggcatcaagggagtcagagagagctgaaagggcaactcttgttacccaggagaaacttcagattggaagcaacagaatgaagatgatgaggctttctgatgtgtggatacgacctgcatttggtggtcgtgggaggaagctcacaggaaatcttgaggctcatttcaatggtttcagatattctacttcaaggtctgatgagcgtgtggacatcatgtttggaaatataaagcatgcctttttccagcctgcagagaaagaaatgattactctccttcacttccatttgcacaaccatatcatggttggaaacaagaagacaaaggatgttcagttctatgttgaagttatggatgttgtacagacgcttgggggcagtagaagatcggcacttgatcctgatgagattgaagaagagcagcgtgagagggataggaagaacagaataaacatggatttccagaactttgtgaacaaggttaacgaccactggtcgcaaccacagttcaaggggcttgacctggagtttgatgtcccccttagagagcttgggttccatggtgtcccatataaagcttctgctttcattattccaacttctacatgtttggttgagctgattgagacccccttccttgtggtgagcctgagcgagatagagattgttaacctggagagggtgggctttgggacaaagaacttcgacatggctatcgtgttcaaggatttcaagaaagacgttctccgcattgactccatcccttcagcatcgcttgacgcgataaaggaatggctggacacaactgacctcaagtactatgagagcaggctgaatctgaactggcgccctatcctgaaaactataatcgatgatcctcagaagttcattgacgatggcggctgggagttcctgaacatggaggcgagtgactcagagactgaggacacagaggaatcagaccaaggctatgtgccttcagacgctgagcccgaatccgagtcagaagatgatgactctgacagtgagtccttggtggaatctgatgatgacgatgaggagtcagacgaggactcagaggaggagaagggcaagacctgggaggagctggagcgtgaggcaagcaacgcggaccgtgagcacggtgcggagtcggacagcgaggaggagaggaggcgccgcaaggcaaagaccttcggcaagtcgcgtgcgccggagcgcagcagcttcaagggagcgccgccctccaagaagccaaagttcaggtgaatgctgccttcggcaattcgctcgtgccaaagtgcagcagcttcaagggagcaccacctccaagaaggcagctctggttaatgggactccttgaagctttggcccccggagtagacgtgtctgtaggagtgtggtttgttatatctagattatctgcagtagcttagtccatctaaatgaaatgtgacagctgaactttggaagtcgcatcattggggaaacgaaatttaagtcgattgatttgttaatgccctcgttgatgtaatatttcccttgttcggtggatttccggtctgtataatatttatgcacgcttgcactttatccatggtatttgtatacccgtataaggcagcatggaggatgtttcttgcatgtggacgcattgattgatatatatatatatttaaggttcttttttttt

SEQ ID NO: 9404 - DNA, 1318 bp, Zea mays
ccagcgtccgaattaacaaatcacactgctttaatggggcgatcgccatgctgtgagaagattggactgaagaaaggcccgtggacaccggaggaggatcagaagctgcttgcctacattcaggagcacggacatgggagttggcgagcattgcctgtgaaggcgggcttgcagaggtgtgggaagagctgcagactgaggtggacaaactacctgagaccggacatcaagaggggcaagttcagcttgcaagaagagcagaccatcatccagcttcatgctcttttaggcaacaggtggtcggccattgcaacccatctaccaaatcgcacggacaatgagatcaagaactactggaacacacacctcaagaaaaggctggccaagatggggatcgatcctgtcacccacaaatctatcagtggcactcgcattggcaccacaaacgacaaatcaaccaaggccgccgcaagcctcagccacatggcacaatgggagagcgcccgcctcgaggctgaggcacggctggctcgagaatcgaagatacggacagcaacgccaacaccaactgctctccatgcgcagccaacgatactacctgcctctgctgcttctccatgccttgacgtgcttcatgcatggcagggtgcaaagatagacctggagtctccaacctccacgctgacgtttacagggagtaatagtggaacgctgccaacccccaggaccaatagactagacgtatcagaaagcaactgtgcagtgtggcatcagaggagtgatgacttggaggatgaagaaaacgattggcagatcttcagcaagcaccaattgctggaactcgacagcaaggagagggaagaggacttcattggttgtgaggagccgtggttctcagagatggctggggttggagctggcttcactggcatgctgcttggtgtatccaatgagcatgatgcatcagaatgctggggtgagtccaataatggccaaactgagcgcagcaaccaagcatcagatgaggaggacaagaattattggaatggtgtccttgacatggtaaactcagagctgacacccaagtcgcctccatttgtctagactctagaatacagtcccctccgttttatttcaagtactcctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagtaaaaaaaaaaaaaaaaaaaaaaaaaaaaaaag

SEQ ID NO: 9405 - DNA, 1350 bp, Zea mays
gtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttaatgtctcggaataatatgaattggctgcattggacgtgtgtgtttctttt

SEQ ID NO: 9406 - DNA, 1728 bp, Zea mays
accacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtgtctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccgagcctaatcactcctactgagctctatatttttgtaattttcatgtgcattccgattccgctgcgagggtcatgtgagcccgctagagaataattgtaatcttctttgctgcgtctgtacttgtgtttttgtgcgccaggacgtatatttttactgaaatgatactccgaagagc

SEQ ID NO: 9407 - DNA, 1205 bp, Zea mays
gctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacc

SEQ ID NO: 9408 - DNA, 2669 bp, Zea mays
gcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggcccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgc

SEQ ID NO: 9409 - DNA, 1716 bp, Zea mays
cttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctccattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaacgaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttttgtgctgctgtggttacatcgttgcccttctaccttacatagttgtgacggcaattgtttcattttggttgaaggtgaaagaatcgagtgggaagggtgaactgtggtaatctaaatcttttctcgcaacaattaaaattcactgcttagtct

SEQ ID NO: 9410 - DNA, 1277 bp, Zea mays
ggcagacgccagcggccagccgcagcgccatggacgtagaagcgcgcaaggacgcagcgcccgcgcgcggcaaggcggtgcgccgctttctggtagcactaaactgcgggatgctggcgctgggggccatcggcgggccgctcctgagccgcctctacttcagcaagggcgggcaccggcagtggctctccgcgtggctcgagaccggcggctggccgctgctgctggttcccgtggcggcgtcgttcggcgcccggcgcgcgcgcgaccggggcgccccggtgctgctcaccccgccgcggatcctgctggccgccgcgggcctcggcgtcgccacgggcgtggacgacttcgtctacgcctacgggctggcgtacctccccgtgtccacctccgcgatcctgatctcgacgcagctggcgttcacggtgttcttcgcgttcctggtggtgcggcagcgcctgacggccgcgtccgtgaacgccgtggcgctgctgacggtgggcgccgtggtgctgggcctgcacgtctcgtcggaccggcccccgggcgtcaccaggggccggtactggctgggcttctcgctgacgctctgcgccgcagcgctttacggcctcgtcctgccgctggtggagctcgcgtacaggcgcgccgcgggcggtggccgcgccgtgacgtacgcgctggtggtggagatgcagctggtgatggggttcttcgccaccgccttctgcacggtaggcatggtcgtgaacaaagacttccaggcgatcccgagggaggcgaggcagtacgagctgggggaggcccggtactacatggtgctggcgtgggcggcggtgctgtggcagtgcttcttcctgggcgcggtgggcgtcatcttctgcgtgcacacgctgctggcgggcatcctcatcgccgtgttcatcccggtgacggaggtggcggccgtcatcttcctgcacgagaagttcagcagcgagaagggcgtggcgctggcgctctcgctctggggcctcgcgtcctactcctacggcgagtggagccaggccaaggccaagaaggagaagaagagcgaggaggacgacggcgaagtggcccaggcagtcccatgatccgtgccccacacacacaaacacaatggtctgccccgttgtactctctgtctgtgtgtatgtaaatgttgtgttgattgcggccgtgttggtcctgtgaatggcgtcctgagtcgtcggttgtcagtgatgtttgatttccagggattaatcttttgtctc

SEQ ID NO: 9411 - DNA, 1887 bp, Zea mays
gcagggcagcctgaaagaaagcggcggcggcagcaggtcactggctcactgctctgtcctctcgtctccagagttcagaccaccgcatcgccatggcgccgccgcagacgatcccccggcgcggcctcttcattggcggggcctggagggagccgtgcctcgggcgccgcctgcccgtcgtcaacccggccaccgaggccaccatcggcgacatcccggcgggcacggcggaggacgtggagatcgcggtcgccgcggcgcgggacgcgttctcccgcgacggcgggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagttatctgtgttaaggagtttaggacagagagtgaagctgtggaacttgcaaatgatactcactatggtttagctggtgccgtgatctccaatgatcaggagaggtgcgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactcttatcattcgaagtttggcagtggtgtgtagttgcacttggaagattgcaataataataaagataattggat

SEQ ID NO: 9412 - DNA, 1457 bp, Zea mays; identical to SEQ ID NO: 1643

SEQ ID NO: 9413 - DNA, 1575 bp, Zea mays
ctcctcctaactacgcctgcctgtttcctcccccgcaggattgatgagctcggcgagggtgagaggccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacattcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaagaccagcctggccatgccgcgaaagccatgtccgcggtggccgtggcggctgctgctgctgctgctacccagcatgctgctgctctggccggcgccggagctactgctgctgctggcctcgctgtcaatcggcaccggcagccggggaagagctatgccacgggtgcgactgatccatgctctctgcaatatagcagggaactggcgaacaaactgtcgaacgagagcgaaaacatgcaggactctgacaatgtctcgatgctgacttccatgaacacaggaaacactgcaggcagcgtgtttccgttctcgaaacagaacactgctcttttcgaagtgagcagctcaaggccagagtttggtcttgttccatcggattcactgacgagttcacctcatagttccttgaagagtgtcaaaaatctgctcagctcacggagtctgagtgagcaccagagctccgcctccctgcaacactttgtggactggcccaggacgccacctgcccagggaggtctttcatggcccgaggcagaggacatgcccagagctcagaggtcccagctctcagtatccgctccaatggcatcctccgagctatcatcggcctccacatctcccatccacgaccacgagaagctgattctgtcacctctcaagctgggccgcgagtataccccatctggcgtcgtcagcgctgcagcgaacagatacgaggttagccagctagaagcgacctgggcgacgatgttccgcgactcttcgacgggcggcccgttgggggaggttctggccaagaacaacagcaacgcggaagcaagaggttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagaaccacggcgcctgctgcgatggtaccagcaacctgatggatgatctcggttcagttgtagtgagacatcccagcatccgcctcttgtgagcccgctgggttctggccatggaaaaagcgtgagggggagcatttaccacgtagtttgtcatttgagactgatctcctgtttctgtcacctgagttcttcttttgttgccctt

SEQ ID NO: 9414 - DNA, 1251 bp, Zea mays
ctaccgccgccgccagatgcgcaggtcttcgtcggctccttctacttctcaggcaacgagcacccggcagtaccgatcgggtgttcttcactgggtccgctcctgcgtgctagaactagaagaatcctctgctcggctcgaacttggaaggggggaggcgagggatggggtccctgctttgctgcatggggtgctcggaggacgtctcggcagcgccgcccgtgagctgcttgtgcctactatggcctttccattattaccacaatttgaactcgggctctgctgcttgtcacagatgtgatacacgggtggcacctgatggtggaaggagtcctcctgcaaatcaagtggattcattggatactttgggtctccctccaaggcctttgccttacgatgatcctcaatccagccctcgcatggtgcaacacccacttgtatcaggacacgacaaagcaccaacgcatgtccagaaactaggacagcctgcagaaactaagaatacccatactgggtcaacttgcacagctcataaggtttctgcgtcctcaccaaaacagcactcagaaggttcaagaatggatgatggagtacaattctgtgattcctctgacagtgaggatgactgtccagtatgcctggaagaatatgattatgagaatccgaagattgcactgcaatgcaaacataatttccaccttagctgcatttacgagtggatggaaaggagccaggcttgcccggtctgtgcaaagactatgttgttcaatgaggatgaatgaccccgccgatggaagtcttcccagacgctggattcatgggctactcgtcagaaaaagaaggagcaaaaaatggtggttctaggaagcaagctaatccgaaagacggcaagtgaggcattcggccgggcctttgggtggtgccctttagataggcgcatttctggttgatatggaagctggaacttggaagatggtgatgaagtttgtttgtctcttgatggttggcttgttcagttccttttgtggcttctgcctgtctgattgggttgtaaataagaaagtcttatgtagttaatcgtaggccaaactttctctgctatcttaggctcttcactaatctagtttgatagtgtttagagtctagatagggttctggccgtgttcgatcttttgggatgatgtgccgcgtggttgtggatgtttcaaactttcctatttcttaatgaaatagggggcttcgccccttcgt

SEQ ID NO: 9415 - DNA, 2543 bp, Zea mays
gcttccttttcatccccacctaaaccaacctcctcgcagcgtaattctgccagtatctcctcatcttctctcgtcgccgggagagcgaacggatcgccgcgtgctcggccgacgggatgagccgggaggcgcagaaactcgattgcgccaccggcggcggcggcggcgtcgggataggggtcttgtcgctggacctgctgggccaggtgctggaccgcctacgggagccgcgggaccgcaaggcgtgccgcctcgtcagccgcgccttcgagcgctccgaggccgcgcaccgacgcgcgctgcgggtgctccgacgcgagccgctcccgcgcctgctccgcgcgttcccggcgctcgagcggctcgacctctctgcctgcgcttcgctcgacgacgcctccctcgccgcggctgttgccggtgccggtgggggcctcgccggcctccgcagcgtgtgcctcgcgcgggccaatggggttggctggcgcggcctcgaggcgctcgtggctgcctgccccaagctggaggcggtcgatttgtcgcactgcgtcagcgccggggaccgcgaggccgctgcgctggcggcggcggccgggctcagggagctgaggctggacaaatgccttgctgtcaccgacatggggctcgccaaggtggctgttggctgccccaggctggagaagctcagcctcaagtggtgccgtgagatctctgatatcggaattgatctgctggccaagaagtgccccgagctccgcagcctcaacatatcctacctcaaggtgggtaatggatcccttagatcaatttcctcacttgagaggcttgaggaattggcaatggtttgttgttcatgtattgatgatgaaggcctggaattgctgagcaaggggagtgattcgctgcagagtgttgatgtgtcaagatgtgatcatgtgacttcccatgggttagcttcactcatagacggtcgcaattttctccagaagttatatgctgcagattgtttgcatgagataggacagcgttttgtatccaagttggcaacactgaaggaaaccttgacaacattgaaactcgacggtcttgaagtctcggactctcttcttgaagccattggtgaaagctgtaacaaattggttgagattggacttagcaaatgcagtggtgttacagatgaaggaatctcatctcttgtagctcggtgtagtgacctaagaacaattgatctcacatgctgcaacctcagtaccaacaatgctcttgattcaatagctggcaactgtaagatgcttgaatgtttgcggttggaatcctgctctttgataaatgagaagggactaaaacgaattgcaacttgttgccccaatcttaaggagatagacctcactgactgcggagtggatgatgcagcattggagcacttggctaaatgctctgaattgagagtattgaaattaggcctatgctcaagtatttctgacaaaggcattgcgtttattagttcaaattgtggaaaacttgtggagcttgatctctaccggtgcagctctattaccgatgatgggttggcagctttagcaaatggatgcaagaggatcaagttactgaacttgtgttactgcaacaagatcactgatactggtttgggtcacttaggctccctggaggagctcacaaaccttgaactgaggtgcttggtccgcataacaggcattgggatttcctcagttgcaatcggatgcaagaacctgatagagctggacttgaaacgatgctattcggttgatgacgctggcctgtgggctcttgctcgttatgctttgaaccttagacagcttacgatatcgtactgccaagtcacggggctgggcctgtgccacctgctgagctccctgcggtgcctccaggacattaagatggtgcacctctcatgggtctccatagaagggttcgagatcgcgttgcgagcagcctgcgggaggttgaagaagctgaagatgctctgtgggctgaagaccgtgctgtcccctgaactcatccagatgctgcaggcgtgtggctgccgaataagatgggtcaacaagcctcttgtctacaaggactagaccacctgttcctcatcgtttgtgaagtttcagcgctgccatggattgccaagagcccaagacctaccaggtttgccctgtgagccatgtgagatgttctgcaatagtccttgtgagatattccgcaataatcgttgggggcgtaacatatctagcggcgattatcggctctgctccagtgtatgtacactgaggcatcggttatgttcatgtgtatagcctgcagtgggatgatccacttcctgggattactttagtgtgtttgttacttcattccgcatggtttgggcctttgaagttaaaagaatcataagaccttgttcggttattgatattacatgtgtattggagtgtattaggtgggattaggatggattttgacttgttatggatttaaaccggctcaatcctattcaatacatgtggattatcacc

SEQ ID NO: 9416 - DNA, 2178 bp, Zea mays
gctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatggcaagcatacatatcccgaacccattctctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatcctcctattctggatccacgtctggaagctttagctgctgagctctatgcattgtgccgatacatgtctgctggttccagaagaatgattgggaattcacaaactgacgaagtaatggaagataaggatgagaaaagtaaagctgaggaagtaattaaggaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcgtttggagggactgtttcatgggaaggagaaggagctccatttaaagaaatagacgaagatatcactcaccagattgttgataggccgacacaaagccatgttttcctctccagggattatgttcaaccacagtgggtctttgattgtgtaaatgctcgtatcatattgccaacagaaggttatcttgttggaagagtacctccaccacatttgtctccttttgtggacaatgatgccgagggctacatgcctgagtatgcagagacaataaagaggctccaagctgctgctcgcaatgaggtgttgcctcttccaggtattggtgatgaagatctagacaattcactggtagcagcaatgatggatcgaacagcttctaacgaagctgctgaaaagaagaggaagctggagatgctagagaagcaatacatcgatgaactgaagaaggaaattgatggcgttgctttctctagtttgtcaaacaaggaagcagataaatcaccgaatgcaaaagatgatactcagtcagatcgtgaggaggatgccagtaaacaagaggaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtgtcatctctagtagaaatgttaccatgatcagctctgcgtgccaatcccccatgatgggtgggttgccttttgatatctgctatgtatgcttaagatgagttcaaggatatgtaacatgaaacttgaatagaaaagttttgatctgtcttacgaagcatttagactcgttattattgtgaaacttgaatagaaaagttttgacctgtcttacgaagcatttatagttattattgagaagcctggat

SEQ ID NO: 9417 - DNA, 2418 bp, Zea mays
ttgccttcctcgcttccccgtctcgccccagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgcccgcgacgccggccccaaggctcgcgtccacatcgtccaccgtcacaagtggcgccgccgccggtgctggctacttcgatctcccgcccgccgtggactcgtccagcagtacctacgctctgaagccgatcccctcgccggtggcggcgccgtcggccgacccgtccacggactcggcgcgggagcccaagcggatgaggactggcggcggcagcacgtcgtcctcctcttcctcgtcgtcatccatggatggcggtcgcactaggagctccgtggtcgaagctgcgccgccggcgacgcaagcatccgcggcggccaacgggcccgcggtgccggtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttgcacgcgcacttctacgagtcctgcccctacctgaagttcgcccacttcaccgcgaaccaggccatcctcgaggccttcgccggctgccgccgcgtccacgtcgtcgacttcggcatcaagcaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacaccatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgttag

SEQ ID NO: 9418 - DNA, 1717 bp, Zea mays
cacaccacaccacacctcctcgcttgcactccgctcgtctgacatctcgtcccgtcctttcgtttcgaagcctcgcgagccccgacgatggccaccaccgcggtgtcggtcgacgagaagctcgataagcttcgcgccgaggtcgccaagctcgaccagatcagcgagaacgagaagtccgggttcatcagcctcgtgtcacggtacctcagtggggaggcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccttctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtgtctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccgagcctaatcactcctactgagctctatatttttgtaattttcatgtgcattccgattccgctgcgagggtcatgtgagcccgctagagaataattgtaatcttctttgctgcgtctgtacttgtgtttttgtgcgccaggacgtatatttttactg

SEQ ID NO: 9419 - DNA, 1165 bp, Zea mays
cgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 9420 - DNA, 3140 bp, Zea mays
ctcgtccaatgagcgggacggggggcggtgagactagagagtggtggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttctgagagatggccgatggggcgagcaagaggctgcaatcttggttcctggtgacatcatcagcatcaagcttggcgatatcgtccctgccgacgctcgtctcctcgagggtgatgcactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgtcgagatcatcgtcatgttcccaatccagcaccggaagtaccgcagcggaatcgagaacctgttggtcctcttgatcggtggtatcccaatcgccatgcctaccgtgctttcagttaccatggccattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgctatcgatgccgccatggttggcatgcttgctgatcctaaggaggccagggctggtataagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagtcccctggtggaccatggcagttcgttggtctgttgcccctgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgctcggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttcttattgttatgtttttcaatagtggagtgtgcgcgtgttgtaatcgtttttacctgcgttttcctctaactagccggtgatctcgcgggaagcgaggtgaagaaataatgcaactaaaattctctgcc

SEQ ID NO: 9421 - DNA, 967 bp, Zea mays
agaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggaatgggtggtatgggaatggatgattttgaggatgatagtgatgaagaagaagtatcgaaacctcaagctgccggacatgctgctgaggccgagaagactgagtcggcggaagccaagactgagtcggctcagagcagttgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttgtgctcatcacattattgatattgtttctgtgatgcttcctttggtcgacaatcatgtgctggagtttgtttactggattgcttttcttctgtggtttttggctttatacctgtatggaaagctggagccgcaaatggagaaatagggaacgacgtgtatttttgtt

SEQ ID NO: 9422 - DNA, 800 bp, Zea mays
gcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcatgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggtttttttttttcttttcctttttgttcgggggagagagaggacagaacggagattgaaggaagaaaatggtggcaacaaagctgttcccctttcgtttctccgaagctctctgttgtctttattcattcc

SEQ ID NO: 9423 - DNA, 1522 bp, Zea mays
ctcccggcctcactcaccagcatcggctcttcagtcttcaccatggccgccgcccacctcctcgccgctttgtcctcctccaccgccttgcgccctcctctccgcctccgttctccacagcatccaccacatatccgcttcaactgtactgggaggcggccgttcccggtggtacgcgcggctgagaccgacgccaaaaacgcgaaggcgaacgccaaggccccgaataaggcacccgcggcggatggctccagtttcaaccagctgctcggtatcaagggtgctaagcaagagagcgacatatggaagatccgtcttcaacttactaagccggtgacatggcctccgcttgtttggggagttctctgtggagcagctgcctctggaaatttccactggacagttgaagatgtcgcaaaatctattgtatgcatgataatgtctggtccatgccttacaggatacacacagacacttaatgactggtatgatcgagacattgatgcaattaatgagccttatcggcctattccatcaggtgctatatcagaaaacgaggtaataacccagatctgggtgctattgctaggagggcttggattgggtgctttgttagatgtgtgggcaggacatgattttcctattgtgttttatcttgctgtgggtggctccttactttcttacatatattcagcaccacctctcaagctcaagcagaatggatggattgggaacttcgctctgggtgcgagttacatcagcttgccctggtgggctggccaggcgttatttggaactcttacaccagatatcattgtcttgactactttgtacagcatagctgggctagggattgctattgtaaatgatttcaagagtattgaaggggataggactctggggcttcagtcacttcctgttgcttttgggatggaaactgcaaaatggatttgtgttggagcaattgatatcactcaattatctgttgcaggttacctattgagcaccggtaagctgtattatgccctggtgttgcttgggctaacaattcctcaggtgttctttcagttccagtacttcctgaaggaccctgtgaagtatgatgtcaaatatcaggcaagcgcacaaccattcttcgtactgggcctactggtgacagcactggcaaccagccattaatgaaggcaaacttaaacagaacgagcaaccgttctgataccgaagaggcacgtctggtgaccattaataagctagctgcttgtgtgcagggtaggaagagaacgtctttttacttgtagaacacagatcgattttgtaagggttatgtggtgggaggaaaagttagcaatagcactggatgttgttgtagtaggatctgtagttgcacggtaagatcgttacttcgccattgttagcggttgaactggcaatgctttgaacaaacagttttgtgtatcggccgtattgttgtatgatcaaccctggaagattgtacaacctccgttctgagtatttgcacctc

SEQ ID NO: 9424 - DNA, 1136 bp, Zea mays
aacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatc

SEQ ID NO: 9425 - DNA, 1742 bp, Zea mays
ttcggattctcctcctctgcctttcgcttcgtcactcgccacgccacgccaaagaccaagaaaaaaaaggacgattttttcctagctgcaacttccctcacgccatggaggaggagatgccgctgcagctgctctccgcttcctccgccgccgtcgctgtctgagctcccccttcgctcgatctctccatcgggccgggcctacctctcctagcagtgaatcaaaccatggcagctttcgccgcgctgttcgaccccctgtactgcccggaggagcacctcgatctgtaccgcgacgaacccggcgagggtgcggacgagcagtggccgggccagcacggacagcaggagccggctgtcctcgacgacgagctgccggcgctgttcgaggcacaccgggccaaggagggggtggtgctggcggaggatggcgggtacggcggcgcagctgggcgtgaggccgcggtcggctgggtttcacgcgccgcggcgcggctaggcttctccgcgctcaccgccgcgctcgccgccgcctacctcgaccgctgcttcctccccgggggcgcgctccggctcggcgaccagccctggatggcgcgcctagccgccgtcacctgcttcgcgctcgccgccaaggtcgaggagacgcgcgtgccgccgctcctcgacctccagctctacgccgccgctgacgccgcggatccgtacgtattcgaggccaagacggtgcgccggatggagctgctcgtgctctccgcgcttgggtggcggatgcaccctgtcacgcccttctcctacctccagcccgtcctcgccgacgctgcgacgcgcctgcgtagctgcgagggcgtcctgctcgcggtcatggccgactggaggtggcctcggcaccggccttcggcgtgggccgccgccgcgttgctgatcacagccgccgccggcgacggcggcgacggcgacggcgacacggagctcctggcgctcatcaatgcccccgaggacaagaccgccgagtgtgccaagatcatctccgaggtgacgggcatgagcttcctcgcctgcgatgtcggcgtgagcgccggaaataagcgtaagcacgcggcggcgcagttgtactcgccgccgccgagcccgagcggcgtgatcggcgcgctgtcctgcttcagctgcgagagctcgacgtccgccaccgctatggctgcggcggtcggcccgtgggcgccgtcggcgtccgtgtccgtgtcgtcctctccagagccaccaggtcgggcccccaagcgcgcagcggcggcgtcggcgtcggcgtcggcgtcagccggggtcgcgccaccggtccaggtcccgcatcagctaccccccgacgaggagagccgcgacgcctggccgtccacctgcgccgcgtgacgcaccgtgccggaaacggtgcctatggcgagaccgccgttcggtggcggtggagaatggagaacaaggagcatcattggctcgcgtcggtgagcaggagaacgaactattttgcccattgccgtgacagatggggggcaagagagataagaaaagatgtccttgtttgcatgcttatggcgggagtaatgtttgcatgcttgtggcagcacattttgcaatgatggttctcagagaacttagctggaggtggaagatgattagcggataatttgccgtcgagatcgatggcgatttagtatttgttgcaactgtagtgatgctagttcttgccgtgtt

SEQ ID NO: 9426 - DNA, 1561 bp, Zea mays
cggcatggatggatagcacacagcgagcgagcgagagcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccggtaaccgtgcacagattggccttcttttttttgccttgtttcgtttttttaaaaaaagaagaaaatggtgcaattttgac

SEQ ID NO: 9427 - DNA, 2044 bp, Zea mays
gatccgttggtgcttgaccgatccatggacacccatatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcggttccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacggcactgagggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcaggaaaggcatttgtcgatatggtagatgccagtggctatgcctatgccgtgatgccatcggccaagggtcttgtgccagagactcacccccacttcatcggcacctactggggcgccgtcagcaccgccttctgtgcggagattgttgagtccgcagatgcctacctctttgcaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagagggttaataagaacaccactgcctatgagaattacaagaggatctttgtacctgagggccagccgctggaaagcgagccaaatgagccactgcgagtgaatgtgctcttcaagcacgtccagaagatgttgactggtgatagcgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcttgggcaagtgctggacctccaaggtgaagagcgaggaggagctgacggctgccattgagacagcgctaggggagaagaaggactgcctgtgcttcatcgaggtgatcgcgcacaaggacgacaccagcaaagagctgctggaatggggctctagggtttctgccgccaactcccggccaccaaatcctcagtagaagtcccgcaggctccaagcctcggagtgccagtagtgatagtaagctgtagcacggtgggggctcaaccgaataacgtgaacgcattgccctttctgttacgtgttttattttattgtgtttctgtggtcgtatatctgttttgtgacgtgttccctgcttctcccatgtgaattccagaagaactatgagaaaattc

SEQ ID NO: 9428 - DNA, 824 bp, Zea mays; identical to SEQ ID NO: 8139

SEQ ID NO: 9429 - DNA, 1446 bp, Zea mays
gtgcccgggaggggtggggaggggagcggcccatttggatttggaagcatcctcggcggcgagcggcggcgtcgcattcactctcatctctctctcacacagattccggctccttttccctctcccccaattcaaaatcaacccccctcgtcgcaaggccacaacaactccactcctccccatccctagctagccactagggtttgccagcctttgcagcgtcgcgctcgcgtctcatgcccttgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaaatggcccgacggcaggctctctttcctggtgactcggagttgcaacagttgcttcacatcttcaggttgctgggaacacctactgaggaacagtggcctggagtgagtgatttaagggactggcatgagtttccacagtggaagccccagggtttggcacgtgtcgtcccaacactggaacctgaaggagttgaccttctatcgaaaatgcttcagcttgatccttcaaacaggatatcagctttagctgcgatggagcatccctactttaacagccttgacaagtcccagttctagccgttgtactatgtggttcagaaggcgctaccctcgtacagagagatttccaatggtgttatgaatctcaattgccatctaggcaactggttcatgattttaccaatctgttagtgagtgaaaatcgtgcgagggtcatatgtgttccccttgtcttaaaaatctggtgtggtgtagaacaagagttacctgtgggaggcctgtgataatgcccttt

SEQ ID NO: 9430 - DNA, 1657 bp, Zea mays
cgcgatccccgaggacacgggggtgacagcctcgccgtcgccggggcggccgtttcgagctccgtcccgcctcggcccggctcagatttggtgggatccggccaagaaatcccgcagttggtgaggaggagaggaggggagaggaagggagggcggaggggatgggcgtcggtgcggagcccaaggatcaggcggcgacggccgctggggtgccggcagagcaggacgaggcgggcgggaaggaggacaaggccgccgcggtgtcctgctcgatctgcctcgacgcggtgctcgctgcgtccggggagaggtccaccgccaggctgcactgcggccacgagttccacctagattgcattggatcagcatttaatgccaaaggggttatgcaatgccccaactgccgcaaaatcgagaaagggaattggctttatgcaaatggttctcgatctgcccatgatgttagcatggatgaatgggcccatgatgaagacctttatgatgttagctactcagatatgccatttcgcttccattggtgtccgtttgggcgcttaacccaacttccatctttatttgaggaaggagaatcatcacctccagttacatttcatgacttcatgggacaacatgtgtttacggagcaagtagctgtatctgctgcagcagggacaactaatccttgcccctatgtggcatacttgcatcctcttacaccattgacgtcattgtcaagctcccatgtccctgacagaactatggatcgtcctgcataccatgatcattggaaccccatggctgggccatcagatgttaggtccatgcaaacaatgcaacctgctgattttcatcatagccattgggcacatgtgccccattcttatggtcaacccaacagcaataacgagcagccaggaatcccctttggagcaagggctgtacgggtcgatggtgatagccaacgccgagcatctgttgtctctccatcttacttcagtaatggatctggttccagatctagacctcccaatgttcctcctctgatgcctcagttcatgagggctcatggcagcatcagcgaacagtaccaacagaattcatcatctagcttatttgctggggcccataggtcaggaggcatgcgacctgccccaacacctctaccagagaaccccacctttaccttgttcccgccaggttcatctggccatagctcgatggagactgatgatgctgggggaagccggttctacgcctgggagggtgaccggtttgccccatacccgttgatgccggtagactgcgagacaagctggcggacctcacagcagcagtcccaccagagcacatcagagcctacatctgctccaaggaggctgtttgggcaatggctcgctgtcggcaggccatccccatcacccgaggggtcttcgtatcgtcaattgcactcaccgcggatgtagaccctcgccgctgaaagaaacgatgggaagcccattgtattaagttaagccgggctgtgccgtgaaactttgggacgatgctcgaggggacagaaactggaaacgatccggctgaggatatttcgatttggtttatgtgaattccatctcgtacatatttgaaatcaagttgggatgctgggagcttcgaatgt

SEQ ID NO: 9431 - DNA, 1393 bp, Zea mays
ccttgctcactctcctcaccactaccctgacctgacctgctcccaagctccctctgcctgcctttataaatcaccggggcagagcgcctcagtgacacacgccgctgctccaagaaaccaccgccgagcccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgctctggctgccatctaccaccaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgtttttttctttccatcgtggagaatttaagttattatccgtttgctgcaaggtttgccgtctcattttatgcgttgggatgttggcaagaaagggcagatgtcatgtgagaatttaagttaagtgaaatcgattcagggttttcttggtttc

SEQ ID NO: 9432 - DNA, 829 bp, Zea mays
ggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 9433 - DNA, 1289 bp, Zea mays
gcccttctccgccactgccactgaagctatactgtcgcagagagagcgccccaccacccgcggaccagacatctgcgatgaccactctggcgacggacacggcggcgtggacacgggaggaggacaaggcgttcgagaacgcggtggcagcctccgcggcgccgccggccgacgggccgcctgatgatggctggttcacggcgctggtggcgagcgtgccggcgcgaacggcggaggaggtgcggcggcactacgaggcgctggtggaggacgtggccgctatcgaggccggccgcatcccgctcccgcgctacgctggggaggagtcgtccgcggcgacgcccgagggctccggtgccgccggcccctccacgcccaaggacggaggaggagggagcgggcaccgacgcgaagaacggaagggcggcgtcggcgctgacgcggggaagagttgctctaaggccgagcaggagcggcgcaagggcgtgccgtggacggaagaggagcacaggttgttcttgttgggtctggacaagttcggcaagggcgactggcggagcatctcgcgcaacttcgtcatctcgcggacgccgacgcaggtggcgagccacgcgcagaaatacttcatccgcctcaactcgatgaaccgggacaggcgccgctccagcatccacgacatcaccagcgtgaccgccggcgaggtggccacggccggcgcgcccatcacgggcggcggcccgaccgcggcgggggcgatgccgatggggccgggcggcatgaagcaccaccacccggttccgccgatgggcatgtacgggcacgcgcccatgggccacccggtcgccgggcacatggtggcgccggcggccgtcggcacgccggtcatgttcccgccgggccatcactcgccctatgtcctgccggtgggatacccggcgccaccgaccaagatgcaccagtgatcgtctacgaccggcatttgcgcagctgcgcagctgcatccctttgctcgttctttcttgatttcgttgatgatcttgtgtagccaaagctatctatccatcctttcctcatctcccgggtctttgttttttgacgtaacatatagatgacttgagcgagtgcagggcaggcaggcgaataatgagtatcgctacttacaggcttaaggaatgtgtaattagtagcagccttcctgggtgcaaatattcatcatttgtgcaactggggactgacagaatcccatttcccggatgtaaatcgattgtctataatatctcatctgtgcg

SEQ ID NO: 9434 - DNA, 1549 bp, Zea mays
cacacagcgagcgagcgagagcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggctaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccggtaaccgtgcacagattggccttcttttttttgccttgtttcgtttttttaaaaaaagaagaaaatggtgcaattttgacaagc

SEQ ID NO: 9435 - DNA, 2000 bp, Zea mays
atcaaaccccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgacctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaatgagttcttcaaggagcaaaaatacccagaagcaataaaacactacacagaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgctaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgttcgttcacgtgcaccctggtcatacatatgttttaacaagcagcagcggcataagaatgaacctgttcgggggctaatcttattccttttggattgtaagtgcattgacattggataattcatgtttgtggcactg

SEQ ID NO: 9436 - DNA, 2021 bp, Zea mays
gccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 9437 - DNA, 1530 bp, Zea mays
gagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgctcctgcaccacgccgccgcggccccgtcgtcgtcgcagcagcaccagcagcagcagcaccaccaccactacgccaggcacggcgccgagatgtcggcagcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggtgttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccatcggaggacatgcctttcgtgatgatggaaggcttccacccgcagaacgccgctgctctgtacatggacgggccgttcatggccgacggcatgtatcgcctcggttcatgaactacacacttccatggacgactgtgggggcctatccaatcgtcggaccgtgggagtatatttcagtgttgcggtgcaaggacattgttgtggaatttttgttgctgattgccaaggggtgggtcggtcgatgtagcgtctatgcatggcttgtagttctcctgtaatgttgttgttaatttccgcttggcggcttgtaatctaggtgtatctctggaacttgaatcctgggtgattaatccggcaagcagctgcctgtttgtatgattgtatggttcgggttggtggaacatgatgcatgctaaggcgtggcctgtctggatcaaaaaaaaagaagatgtcttttgtaccagtggaatgattggaacttcagattgctgaac

SEQ ID NO: 9438 - DNA, 1113 bp, Zea mays
tcctcttcctcctccgaggttccgatcgccgcccgcacctgcgtctccgtcggcgaggtggcggtgggcgcggtggctacaggcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagtttctccaccagcagtaccaatacgatgatgacgaagatgatcttgacgaggaatcttattacatgaacaggtccccaagcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgctgtctgcacgactgttgcagctatgaagctgtatgtacctcactgttggtgcactattttagttattgctaatcacaggggatgcaatcggcatctgtgttgattact

SEQ ID NO: 9439 - DNA, 1615 bp, Zea mays
cgggcgtcagggaatgcctggaggaggtcggccacatcacgcgcctcgccgacccgcgggacgcctggctgcccatcaccgagtccaggagcggcaacgcctactacgccgcgttccacaacctcagctccggcatcggcttccaggcgctcgtgctccccacggccttcgcatcgctcggatggacgtgggcgatcatctgcctgaccctggcgttcgggtggcagctctacacgctgtggctgctcgtcaggctccacgagcctgtcgcgggcgccacccgctacagccgatacatgcacctcgccaccacagttttcggcgagagatgggccaagatcctggcgctgctcccggtgatgtacctgtcggcggggatctgcacggcgctcatcatcgtcggcggcggcagcatgaagctgctgttcggcatcgcgtgcggcgagccgtgcccggcgcgcccgcccaccaccgtggagtggtacctcgtcttcgtctgcgcggccgtgctgctgtcgcagctccccaacctcaactccatcgccggcgtgtccctggtgggcgcgaccgcggccgtcgcctactgcaccatgatctggaccgtgtccgtggccaagggcagggtgcccgccgtgtcctacgaccccgtcaaggcccccagcgacgtggacggcgcactcgccattctcaatggcctcggaatcattgccttcgccttcaggggccacaatgtcgtgctggagatccagggcacgatgccgtcgacactgaaacacccatctcatgtgcccatgtggaagggggttaaggtagcgtacgccatcatcgcgctctgcttgtaccccgtcgccatcggtggcttctgggcttacggcaaccaggtacgtgtaccacatatatacatacatacgcacgggcttcggacgacgtcgagagtgactgatgatttgcgatgcacgcgcagatacctcccaatggcatcctgagcgccctgtacaagttccacagccgcgacacgtccaggctagtgctgggggtcaccacgacgctggtgatcgtcaactgcctcaccacgttccagatctacgccatgccggtgtacgacaacatggaggccgggtacgtgcacaagaagaaccgcccgtgcccgtggtggatgcgctcgggcttccgcgccttcttcggcgcggtcaacttcctcatcgccgtcgcgctgccgttcctgtcgcagctcgccggcctcctcggagggatctcgctgccggtcaccctggcctacccgtgcttcatgtgggtggccatcaagaagccgcggaagggcaccgccacgtggaacgtcaactgggcgctgggaatcctcggcatgagcataagccttgtcctcatagtcggaaacctgtggggccttgtggagaaaggcttgcgggtcaagttctttaagcctgccgattcccagtgaaaaaaaggatgcagatttgtcaatcggttagatttgtaatgccatgcttttatatatgttgatttcttcgccaggaacgtataatgtcctcctgcaccttgacaatttgcaagaaagcaaagtccagttaaggtactcgtggtcgttcctcgtgcc

SEQ ID NO: 9440 - DNA, 2345 bp, Zea mays
gcagagcagcgcaggcgccctgcacctccactctgcagctctgctccccctccctctctcccgctcctcctccttttccttctccagctcggccgcctcagcccgcgccgcgatgtcagaggaggacgaggaccagccgccggccaagcgacccagcccgtcgccgcccgcggaccaggtgctcgacaacgtgctcgagacggtgctccagttcctggacgccccgcgggacaggagcgccgcctccctcgtctgccgctcctggcacagcgccgagtccgccacccgcgagtccgtcgccgtccgcaacctcctcgccgtgtcggccacccgcaccgcgcgccgcttccccaacgcgcggagcctcctcctcaagggccgcccgcgcttcgccgacttcaacctcctcccgcacggatgggacgcctccgccttccgcccctgggccgccgccgtcgccgccggggccttccccgcgctcacctcgctctacctcaagcgcatccccgtcaccgacgccgacctggacctcctctcccgctccctcccggcgtcattccgtgacctcaccctgcacctttgcgacggcttcacctcgcgcgggctcgcgtccatcgcctcccattgcaggggcctgcgagtgctcgacgtggtggagtgcgacatggccgaggagcaggaggttgtggactgggtggccgcgtttccgcaggagccctctaacctcgagtcgctctccttcgagtgttacgagccgcctgtggccttcgcggcgctcgaggcgctcgtggagcggtccccgcgcctcagacgcctgggggtcaatctgcacgtctcgctcggccagctgtgccgcctcatggcgcacgcgccgcgcttgtcgcacctgggcaccgggtcgttccggccggcggatggcggcgaggaggggacaggattcggggaggttgtctctgcattcgtggccgctgggcgagcgcgcacgcttgtttccctctccggcttccgtgacctcgcgcaagagtacctgccgaccatcgccgtggtgtgcgcccacttgaagagccttgacttaagctactccgcggtcaccccgaatcagattctgatgttcattgggcaatgctacaaccttgagacactatgggtacttgactcggtgcgcgacgaagggctcgacgccgtgggaatttcctgcaagaagctccagtctcttcgtgtgctcccgttgaatgcacatgaggacgccgacgagttggtgtcagaggttggccttaccgccatctcacggggctgccctgctctccgttcgatactatatttttgccagaccatgaccaacgctgctgttgtggacatgtcgcggaactgcccggagctgaaggtattccggttatgtataatgggacggcaccagccggaccatgcgactggggagcctatggatgaaggattcggtgccatcgttcagaattgcagcaagcttaccaggctatccacgtccgggcaacttactgatcgggcatttgagtacattggcaggcatggcaagtccctgcggacgctctccgtagcatttgctggaaacagtgatgtggcgctgcaatacatcctccagggctgtccaaagctagagaagcttgagataagggactgccctttcggtgacgctggcctcttcgccgggatgcaccatttctacaacatgcggttcgtctggatgtcaggctgcaacctgaccctgcaagggtgcaaggaggtggctcaggtgctgccacggatggtggtggagttgataaatggccagtctgatgagaacgaaaggaatgaaagcgtggacatcttatacatgtatcggtcactcgatggtccaagggaggatgttccaccgttcgtgaagatcctgtgaagctgcgcttctgcggagatggctgggtatcgctatcagtgtagtattcaggctgctgcacttgatatgctggctgagtgcagatcatttaacggaatatatatgtaagttgttgagctgcagatgtggtacatttttatctcttagaaagatttcgaagcactgtactggagcggggcgggcgggggtatcatgtagtaggagttcatcagatgtggtacatttttatctagtaggagttcatcagtgtatccaaagcgttcacggcaggaggactaagtgcagcagagcaggcttcttcgagggggcctcatggctgcctcagttttgtttgctgctctggagggggctctggtttgaggaccatattttctgtgccggtgcaaccaccatgttttccttcaaattttcgaaatgaaacctgtcatatcagact

SEQ ID NO: 9441 - DNA, 795 bp, Zea mays
cccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttg

SEQ ID NO: 9442 - DNA, 1820 bp, Zea mays
tttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 9443 - DNA, 2747 bp, Zea mays; identical to SEQ ID NO: 2030

SEQ ID NO: 9444 - DNA, 917 bp, Zea mays
gttttccttcccccgctttctccttccttcttcccccctccccgctcccctcgcccagccaccggccatgtcggtggagacggagcgcagctccaccgagtcctccggggcctccgggctcgacttcgaggacaccgcgctcacgctcaccctccgcctcccgggctccgcgccttccgccgccgcggcctccctgtccctctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctccaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccgagagccgcccgatgaggcacactccgttgggcgttggcacgcactggcgtcttgaaggaaagcgggaactctgctggtcttgatgaggatcttcacgtgagataggaacgtgtgtacagttgtcgccttatggtattgagttgaggaaacttggaggttccattacttgtctgtagtctctactttatatagatgcgaagaagcttgagat

SEQ ID NO: 9445 - DNA, 2807 bp, Zea mays
gtctttggtcccggagggaaaaggacaaatcactcacacagagggaacaaaagggcacaggaatcgcgacagcgtgggaggcgtacggcgcaccgcccggccgccggatctgcgccggcgacgcgcccggacgtcggatctacgccgccgcaggaggagggaggcggcgctctggccgttccttgcccgcgagcgcccagatccgtcccgccgccggatatatatatcaatcaatgcccctgtgatatcgagcttcagttgatgcagtggtgaaaacatcttctcgaaaaactgctggctgcaagttgcaaaagtttgtctttcccttgttgtgttgttgcttccttctctggtggagtacacgggagaagtttgcagatacaggcagctcctttcaaatctcctatgtccagggatttggactgtcctgttcagacacagatggctgtggcagtcctggaccggagctttagcagcgaatatcctggaggtagcagaattgaggggaggcaactgagctggaagagagtatttgtccaaactgacaatggttctgtccttggcatcgagctggagagaggagaaaacgtacaaactgtgaaaaagaagctccagatagccctcaatgtgcccactgatgagagctcattgacctttggtgacctagttctgaataatgatcttagcagcattcgcaatgactcacccttgtttctcaaaaggaatcagattcaccggagcaattccacaccttgcctctcacctacaggtaagaatgttttgcaaagagaccggagtggacccattgaaatccttggctgttcaagtccttcatctcggatgaagcagcttgctaaggatgtcattaaagccataatgaatgatgttgacccagtcgctgttaacagtgggatgggtggtgcctactacttcaagaacatttggggagagcgtgtggcaattgtcaagccaactgatgaggaaccatttgctccaaataatccaaaaggttttgtggggaaagctctgggacagccgggcctgaaaaggtctgtacgggttggggagacaggcttcagagaggttgctgcttacctcctcgactatggtcactttgcaaatgttcctcccaccatgctggtcaagataacacacacaatcttcaatgtgaacgactgtgttggctgcaaaagtaaagtgttctgcaacaaatcagaggctgtgagcaagattgcatcgctgcaggagttcattcctcatgatttcgatgccagtgaccatgggacctcaagcttccctgtatctgcagtgcataggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccactggccgcaggcatctgttcctttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcaggcagttcactgcgaaggaggaggaaccgagtcagcttgagctgctctgcatggaggcaaggaagtgggttgaggaaagagagtcctttcttcccaacgaagccggagttgaagatgacgatgatgacttcacccagttccttatcgacggcgaggatgattatccggatgccttggaaccatcagctttctgcaagtttggtagcatgaaggcaagttctaggaatccactgtccaagctagatgagcgtgacgaggaagacggagacgggaccgaggaggacgacgacgacgacatcttgaccggtgcattgcctcagaggatctcgtctatctccaagctgtcgtcatccatgaaggggcttggcttcattgggaaacccaagccctaccgcacgtgccttcggaagggtaaagcgacaggcagaactaagtacaccggcaaagccagcgagcatcagtccggcagcaggagcgccaacgagctgctcccgcccagcgccagtttcgtgaagctgtcggacatgagccctaaacagtggagcgcattcctcgacaagttccaggagctgctcccaggtgccctgagcgcccggaagcacgctgccggtgtcgtcggccagcgctcgatgccgaggctgggcacgtcttgccagttttgagagtagcagaagagaagccaccgaacccaaggtatgacgaacgcgcttctgttcgagctctggtgtgcagcagccaagcaggtacggagtattatatatgcttgtagtaggtgtctggagccggtggtggtagagagggtccgagaataagatcatccatggcatgtgagatgaggttgcgggagaaggaagggggttgtgtgtgtttgtgcatagtgtttcgcataagaggtccgttgttctttttttcttcttctctgtatatagttaagtactcctactgctactgcatcgcagcaccgggcacgggctgggatctcggccgttgttatctgaacgatggtggtgagtgtgctggcgtcgcctgctctctgctctgtctttgccgctgtaccattttggaggcgcttaccatattatgaactttgaactatgatatgatgttcgct

SEQ ID NO: 9446 - DNA, 819 bp, Zea mays
cttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 9447 - DNA, 1416 bp, Zea mays
ctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactacgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcagtatccttttgatataatctccatacttccatttacatgtactggccgttttatgctatatccttcttaagcgatttatattttgaccaccctttggaactattgatttttttttgcaacatcgttttatgtgttctctggtctccatgccaacaccctggtgaaccacattgaacattccgtcagtcctgcttttctgtcgttgaactcttcctcggtaaataatggatatttgcaagctgccattacatgcccttaactttacccagacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttccgccagaagcacccctgtcacctaggttttagggagagcatcgtggccttcaaatactgttgtattattgatgtacgaattcgcgagcctgggcctcgctgtaaactattgtgaaattgtatctgttttccgatattattactgttgtgtaaccttggttctctctc

SEQ ID NO: 9448 - DNA, 1162 bp, Zea mays
aattcgtttatttcttcccaccgagccaagctgcgacgacggcggtcgcagcgtcgccttccctccctccgtaccgccgacgccgacgagcatattgggccgagcgcccgagcacctctcctgtcagcagcggcactcgccattccaagtacgaggtcgacgcgctgtggggcttgctgaaacgagcaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatctgttgacacttcgcccaccaacgcaaatcatgccaactacggggggtcccctctgctgaacgcagggagggtacaagcttcgctgcgcaaatccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaaatctcaatgctgttgttggggtctgtgtaactgaattctccctagattttgttgcaagtgttgaagttattgccaagttttggttttggaccc

SEQ ID NO: 9449 - DNA, 975 bp, Zea mays
ctgcaagctcatccgtctctgtcgatcagcaagaggccggggtcagaggaatggcggcgacgtcgcggctggcgctggccctcctgctggccgccttggtggcggcgtggcagctgccggcggcggcggtggcggccaactacacggtgggcgacgagaaggggtggaacccggacgtggactacacggcgtgggtgaagaagcacaagccgttctacaagggagactggctcatcttcgagtaccagaacgggcggtcggacgtggtgcaggtggacgaggtcggctacgacaactgcgacaaggccaacgcgctgagcagctacagcaagggccacacctacgccttccagctcaaggacgccaaggactactacttcatctgcagctacggctactgctacaacggcatgaagctccacgtcacagcaaagtcatcatcctcatcctcctcttcctcgtccggatctgactcctcctcctcctcctctgacgacgactcttcctccccctcgccgcccgccaagaagtccaaggccaagaccagcgccgcgccgccaccgtcactcctcgctgccacgcccatggctgccgccgccgccgccgccgctgctctgctcctcaacaggatgctctgatctggtctggtctggtctgctctgcgtatgtagtcacgtcacgtggctccagatcttgcttgggcgctgatgagctacactacactacactagtttttttcttctgcttttagtttttttccccctcaccacttgagattggggaggcatcttctgcttctagcttgcttgctgcttcttgaattgcgtgactgttattggttggttcttgcttccattattttgcctttttctttctttctttcttgcttccagcttgttgttgatgcagttttttttttcaagagacaagattagtataatgtcaagtgtgaatgaagagctctatttatttatc

SEQ ID NO: 9450 - DNA, 1295 bp, Zea mays
ttttgctgctgattagacaaatggagcatagcaacacacaatctggagctgctaaggtttctattttaatgattggccaacaagctatcatggatgcatatctctgtctacttcacctgactgctgggatattggttgagtcactcttcaatgccttcgcaacggctgcattcttcaaatttgttgtattttctatttttgaaatgaggtaccttctcgccatatggaaagcaagtaggcctttaaacagtggagaaggttgggagataatgaggcgagagctgtctgttctttacagccgcttttatggcattctgttgggaggaatccttctaatgtatgagctgcacaatttcttacgcccacttctcctcctgatgtactccttttgggtacctcaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaaggtagaggacagcacaaatcagcccatcgattgtgttatttgcatgactacaatcgaccttacccaaagaacaagtgaatacatggtggcaccttgcgagcatatatttcactcaggctgtttacagcgttggatggacattaagatggagtgccctacttgccggcgctccctaccaccagcttagatgaggctttgtatcatatataatagtgaacaagaagtaggtagctcagcttatacaaggtgggggaactgatgtacaataaggtgaggctgcaatcgtgtgaaagctatgaacagaactgtagaaaagttttatactattgatttcaagaggtcttgtgttgtgcaaactagcgtatcaagcatcccacgaagaaatcgtccttccccgctcatgcggttatcactgttgcatgcctttgcctgctaccagtatttcggcccagcgttttggtctgagctttgtgcaaagtttgttaacgccgtgaaagagttcgagatgtgcattcttgatttggtggacacattagtagcgtgtttggtttgaggaatgagatctctctcactcacttttttgtttggtttgtggaatgaaatgaattaatctatcaccatttcattt

SEQ ID NO: 9451 - DNA, 2226 bp, Zea mays
ccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctacttttttg

SEQ ID NO: 9452 - DNA, 1235 bp, Zea mays
aagacgtcaaaggggattccaccggcgggaagcgattgcgagcatcggagtcatttcaaagtggcgtaggaagcaaagtgaagctatgcaccaattttttcagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtccttcgctgttggccaactaaatctgttttctgcgtttgttct

SEQ ID NO: 9453 - DNA, 1068 bp, Zea mays
ctccactccgcttttgcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcttcaccacagcaagccccatcacatgttggcaatggattattctttcatcccctggaagctgcagcagagccaaccctgcagatcgggttcgctcccgagcatatgaataatttcatgccggcatggctaccctgaagatggatctttgaggcaaagggaataaataaagatgcgatgcatgtcagaatcatattgtactgcaagagtgacaattgtgtgttccactcacatatatgacctagttttgtgtgtctatatgtcgaaaccatatgtctgtgattttattatatgtaatgtaagcacagatgaaacatgcagggctagttgcttttgcttgtct

SEQ ID NO: 9454 - DNA, 1594 bp, Zea mays
tttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttttgtgctgctgtggttacatcgttgcccttctaccttacatagttgtgacggcaattgtttcattttggttgaaggtgaaagaatcgagtgggaagggtgaactgtggt

SEQ ID NO: 9455 - DNA, 1126 bp, Zea mays
cgtcaaacaaatctagggttccaagcgagcgaataccttcctccgcctgccgatctccccgcatctctcgggctaagacgattcgaggcacgagcgaagatgccgcagcggcattcgaaaaacaacaacgacctcgccttcttcacgtacgaggagaagcggaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaggagaaagaagaggaggaagagaagctaattctgcagaaggctaaggagttggatgcctttgatcagcagaatcatggagctgttccccagtaccatgatcgcagtggttcccaatacaagaatgggtttcatggagcaaatagtgtgaaggtcacttcttttgaagaggaagcccttcgcaatatgaaggcattctggctcccttcagctactcctgaagctacggtcaaggtagacttgccctccaccgacactgtttgcccggaggggcaggagaagcttaagttgaaatcgctcttccctatctcgttcacagaggaaactgctgatcagaagagcagcaaggcaggaaactcctgtagctacatgtgccctagttgcaagtccactctcacaaataccatgtcccttgtggcggtgagcacctgtggccatgtcttctgcaagaaatgttccgacaagtttctagtgaaggataaagcttgcttggagtgcagcaaaccattcagggagaggaatctggttccattggagaaaggaggaactgggtttgctgcacatgatgaacgcctggaggcaagagatttcaagtatttgggtagtggctctgggttagggctagtgaagcctgcaccaaaaacttactaaccttgaataattatagctgatgttgtgtattgtttaccatggtgtcatgaaattatgtaacctggagaattttgttttatggcatcaaaatcgttgtattcagaac

SEQ ID NO: 9456 - DNA, 735 bp, Zea mays
tccaattgtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtt

SEQ ID NO: 9457 - DNA, 1145 bp, Zea mays
gccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 9458 - DNA, 829 bp, Zea mays; identical to SEQ ID NO: 9432

SEQ ID NO: 9459 - DNA, 1582 bp, Zea mays
agcgagttatctccggctcgaacccgtactcctcaagcaaaaccactggaggagcaccaagagttatctccggctcgaacccgagccaggtcctgactcctgatccgcaccgcacacggcaagggggcatcgccgacgggccgtcagcggcgagacccaagccaacacagcccagcgatgtcggcgcgtgaccgcgagacggccgaggcgctggtgcgcctcgccgcctcgctggacggggcggtgctcggcctcggcacggctgccgtcgccgtcgcgtcgtgggtcaagtacctcgccgtctcggggcagctacgcctcgtcgcctccgcggcgacggcctccatcgccgacgcccgctccctcctctcaggcgacggcgccgagccgcggatcgccgcggtgcggggctacgtgcgggcccatgacaagttcttccgggccccgttctcaggcgaggcgggcgtcgtcacgaagcacacccagatgtgtttgttcacagaatggagaggcatctttggatggacctttgatctgcatgctcttcttttcagatcatggaaagagcaaattgtgacgtcttttagatcggttccatttgttctggttagtactgaattaggaaatcctacgggagtggtacatataaatgtggataaggcggatcaaccgttgcctcttaccacagtgtttcataaacttatcccacttgagacgactccttacacattgtttcaaactattattggcaacggctatccgattgcgttgttggatgaagaaaaaatactaccgattggtaagaaaattacagcaataggactatgtcaagcaaaggatgcagaaagtgttgagataacatcgtgcccagagatcccctttttcttatctgaactaaccaaggatgagatgcaagctcagctggcttcacgtgctaggatactcttctggggtagtattgttttgggaaccttgtcggtttgcctagtgggccatgccatttacaggggctggacgagaatcaaactacgaagagaggctaggcatgcacgacagatgtttgaggaggctgaagatgctattcacagggatgactctagtgatgatgatgaaataggagacgggcaactatgtgttgtgtgcttaaggaagagaaggagggcagcttttattccatgtgggcatcttgtctgctgttccgaatgcgcattaacaatagagcgtacacctcatccattgtgccctatgtgtcgtcaagacatcagatacatgatgagggtttatgactcttgaggtatgctgctgataagatctacacgcttccttgctgacccatgcaaacctgaggagcacaactgttcgtcctgctgggcgttttcctagtcaaggtggcctaccctggatttgtgaatataatgtcttgaccctccaaattatgctcttgattgcctgggacaaatagcttagctgaagtcatgaactaacgtagagttattttttgtttgctttgcgcatatgtctatccatcatgtaaagcacagggtttactgcaaataggttaaagatttggacattttctgcc

SEQ ID NO: 9460 - DNA, 1143 bp, Zea mays
cgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 9461 - DNA, 1789 bp, Zea mays
ttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcgactcttttggttgctcggcgactggggagcgacttgtgtctgctgcaagagatggagacatccaggaggccagggctctcttagaactcaatccccgccttgctcggtactccacgttcgggatccggaattcgcctctccattactcggcagcaaagggccaccatgagattgtctccctcctaatcgagtccggtgttaatattaaccttagaaattgcagagggcagactgctctgatgcaagcttgtctatatggtcactggaaagttgtacagattctagttctttttaaagctaatattcacaggagagattgttttagcggcgcgaccgctattcattttgccgcgctaaaaggtcatactcgctgcattcggcttcttgtggctgattatgtgcctagcttgtcagagttttggaccattatgcgtggaaagtccacagatgaaatgaaaaagggtgcctttgatgccgcgtctctccagagactagttaatggaaagtctgatggtggtgtcaccccgcttcacttggcagcccttcatggacatgctgagagtgtacagttgctgctagaccttggagcctctgtctctgaggtgactgtcaatgatggttcaacaattgacctcattggttcggggagcacacccctccattacgcggcgtgtggtggaagtgctgtttgctgccaacttctcattgcagcaggagcaaacatgggagctcaaaatgttaacgggttgactcctttattggtggctcgttcgtggcacaagactagcatcgaaggtattctaagcaagcaaccagaaaaccgaatgcgtattcttccttcaccatacctttgcttaccactgatgagcattgtcaaaattgccagggaatgtggatggaggaaaacttccgcctcatccacttgtcaggatccatgtgtcatatgtttggaggtggaatgcactgtagctgcagaaggttgcggccatgagttctgcaccaaatgtgcactctacttgtgctccaccactagcagctcaacatccacccgtggagttcctggctccatatcatgccctctgtgtcgccatgccatcgtctccttcatgaggctcaccagcactaccccgataaaggagcttccatggacaagcgcgtcactagctctatgtgcagcgggctcaaacactggccgccctgaacatggcgggtccttgcatcgaaggcctgacctgcgtcgactgcgctccatctcagttcagctgggatgctcttcttttagatccattggctctgggaagctgtcgtccatgaagctgaactgcacaggagctgaagaggcggtgccttgcctcgtcagctgcctcaggcccgatgtgcagcgttcatcgtcgtacaggggaagaattaggagatattcagagttttgaaaggatggttttgtggcgtccttcctgcgagtttttagggtttgggaatttaaacctgtgtcgtcatgttcctcttcgtttgtttccctgttgtttaatatgcatgcagtcctcgttgtgaagatctatttgtgtacatggcccgtttgtcttcattacttttacttatatgtgaattatataccatctctgttttgcaattaccgac

SEQ ID NO: 9462 - DNA, 1584 bp, Zea mays
gaattcccgggtcgacccacgcgtccggagcgcgcacatcatcacggcggtgatcggctccggggtgctctcgctggggtgggccatcgcgcagctcggctgggtggccggacccgtcgtcatgctgctcttctcgctcgtcacctactacacctcgtcgctgctcgcagactgctaccgctccggcgaccccagcaccggcaagcggaactacacctacatggacgccgtcaacgcgaacctcagtggcatcaaggtccagatctgcgggttcctgcagtacgccaacatcgtgggcgtggccatcggctacaccatcgctgcctccattagcatgctcgcgatcaggagggccaactgcttccaccagaagggacacggcaacccctgcaagatctccagcacgccctacatgatcatcttcggcgtggcggagatcttcttctcgcagatcccggacttcgaccagatctcctggctctccatcctcgccgccgtcatgtccttcacctactcctccattgggctcggcctgggcgtcgtccaagtcatcgcgaacagaggcgtgcagggcagcctgaccggcatcaccatcggcgtggtgaccccgatggacaaggtgtggcgcagcctccaggcgttcggcgacgtcgccttcgcctactcctactccctcatcctgatcgagatccaggacaccatccgggcgccgccgccgtcggagtcgacggtgatgaagcgcgccacggtggtgagcgtggcggtcaccacgctcttctacatgctgtgcggctgcatggggtacgcggcgttcggcgacggcgcgcccgggaacctcctcacgggcttcggcttctacgagcccttctggctcctggacgtggccaacgccgccatcgtggtccacctggtcggcgcctaccaggtctactgccagccgctgctcgccttcgtggagaagtgggccgcgcagcggtggccggactcggcgtacatcaccggggaggtcgaggtcccgctcccgctcccggcgagccggcggcggtgctgcaaggtgaacctgttccgggcgacgtggcggacggcgttcgtcgtggccacgacggtcgtgtccatgctgctgcccttcttcaacgacgtggtgggcttcctgggcgcgctcggcttctggccgctcaccgtctacttccccgtcgagatgtacgtggtgcagaagaaggtgccgcggtggagctcccggtgggtgtgcctgcagatgctcagcctcggctgcctcgtcatctccatcgccgccgcagccgggtccatcgccggcatcgcgtccgacctcaaagtctaccgcccgttcaagtcctactgatcagattcacggcctacgggagacgcagcagcatgtggtatataggcatatactagcaaccatgttcgtgagttgcaactcataagtacttaaatcagactctgcatcattgctaaacgcgagtttttttaacttgtatacgcatgattcatgagtcccaattacatatgaaaaggatgcaaaaaaaaaaaaaaaaaaaaaaaaaaaaaaaaaagggcggccgc

SEQ ID NO: 9463 - DNA, 1558 bp, Zea mays
catggatggatagcacacagcgagcgagcgagagcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccggtaaccgtgcacagattggccttcttttttttgccttgtttcgtttttttaaaaaaagaagaaaatggtgcaattttgac

SEQ ID NO: 9464 - DNA, 1508 bp, Zea mays
ctccctcccccgtccgccctgcactctccagctcaacaaggaagaagagggggccttcaccacaccactcgattcctctttagagcacgacttacgaagtgtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccgcgccaggtcgccgtctggttccagaaccgccgcgcccgctggaagaccaagacgctcgagcgcgacttcgcggcgctgcgcgcgcgccacgacgccctccgcgccgactgcgacgcgctccgccgcgacaaggacgccctcgccgccgagataagggagctgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccctactccggcggcgcggcgttcgagccgccggccttggccgggctcggcgcgccgttcctggacacgtcggtggcgccgacgggctgctcgtctccccccgttttcgtcgagaccaagtggcagcagcacgggccgacacagtacccgttcccattcgactcgtacaaggcctgcgccggctatggcttcacggaggaatggctcgccagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccaggctagtaaaaaaagaggatgtaaatgtaaaaagaggtgtcgcacc

SEQ ID NO: 9465 - DNA, 2351 bp, Zea mays
tcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagctcttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttccttaaggacgatcagctggagtaccttgaggagcgtcgcctcaaggatctggtcaagaagcactctgagttcatcagctaccccatctccctgtggactgaaaagacaacagagaaggaaatttctgacgacgaagacgaggaagagaagaaagatgctgaggaaggaaaggttgaggatgttgatgagaaggaagagaaagaaaagaagaaaaagaagatcaaggaggtttctcatgagtggtcattggtcaacaagcagaagcccatatggatgaggaagccagaagaaatcacaaaagaagaatatgctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttcccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctacctgtgatagcttaattttcactattgttcgaggtttttggcacgttatcggttgtcctgctggccaggctataagtctggtttatctgttatgtttaccctttttaacagtttgtcgttattattcgtaatggtaaaaatgtagtacatgttttgccc

SEQ ID NO: 9466 - DNA, 1513 bp, Zea mays
agaccagcgaccgtttcactccccgcgccacgcgcctgactgggtgcactgcactggtggtgtgcacgcccctcgtcagtcgtcactcactcgctaccccatatcccattccccccgacggcgcctctggcagcaaggaacaatatgtccaatagggccacccattggtgttatgcctgtcagcgcccaattcgtcttcgcgggcaggatatcatatgtcccaactgcagtgatggttttatccaagaaatcagtgagatgggtggcgtactgaacacttatgggctaactgaaccggactttgaagagcgccaggccagaagatttggaatgatggatgccatatcttccctcatgcggcaacggctgtcagaaataggaagggatagtttgtttgatattcacggtagacaagggacaggtactgaatatggaaggaggtcaactgctattcctacgctggtatttggtggcatcccttctcctgcagttggtagcagtgatatcaatgttgtcatcagggaaggccgcagagctggcgctgcccgtccgaatttcagtagcttagttgttggtcccagtctggaagctctatttgagcagctactactccagaacaaccgtcaaggcccaccacctgctccacagtcagctattgactccatgcctgtggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccatcacagcgatcaggcagtagtaccagcagcgcccgtgtgccttcagcatactacaacgaaacagcttgccctcctgcggtcgccagggcagatttcgatcctgtgccttcagcatactacaacgaaacagcaactgatcctcctgcggtcaccagagcagatttcgatcctgctccaggaaactacggcagcgaaagccaggaaagtcacgtccccttctcctttctctggccatttggcccgtcgagttcttaccaatatgaagaaaatgttgatgaacctgcagtatacgatccaaaccagatagcatattctgcgtggcactatgaccactgactgaaaccctgagttaaaatcaagatatctgcaattcgtgccttgagctctcagctttggtgaggcaaagggctgcttgccgtataaaaaatggatggttattgtgttcagtgcatacccttgctacgcatgtccgttgtggagatatcagctgtgtatagaactgggcgcaataaactctgctgtaatgcccgtatatattccttttcggtatatcaagtctaaagctacataatcctgtatgtgcagtaatcggtgaactgagtgcatccagaatatcatgtcatgataaacatgattataattacatggttgtctttttagactg

SEQ ID NO: 9467 - DNA, 1373 bp, Zea mays
tcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccaggcggatgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaccacgtcatcaatccgggccactggaccgaggacatgcgcgacgacgcgctggaacctgccgacctcttcagccgccacctcacggtcgtcgacgtcggcggcggcacggggttcaccacgctcggcatcgtcaagcacgtcaacccggagaacgtcacgctgctcgaccagtccccgcaccagctcgacaaggcccggcagaaggaggccctcaagggggtcaccatcatggagggcgacgccgaggacctcccgttccccaccgactccttcgaccgatacatctccgccggcagcatcgagtactggccagacccacagcgggggatcaaggaagcctacagggtcctgagatttggtgggctagcttgtgtgatcggcccggtctacccgaccttctggctgtcccgcttcttcgccgacatgtggatgctcttccccaaggaggaagagtacatcgagtggttcaagaaggctgggtttagggatgtcaagctgaagaggattggaccgaagtggtaccgcggtgtccgaaggcatggcctcatcatgggctgctccgtcacaggcgtcaagagagagcgcggtgactctcccttggagcttggtcccaaggcggaggatgtcagcaagccagtgaatccgatcaccttcctcttccgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaattttactcttctctatattagacgcttcctgcctgttttgtattaatacctcttgttttccttctgctatttacttcttgcactgctgttcctgtttgtggtaattaataatactaagacatcgatgttctcctgtttcttgagcatgactggttgcagtggaacctcgaaattaaattatatgatgtgtaatttagttggttaaattatataaatttgtatagttt

SEQ ID NO: 9468 - DNA, 1179 bp, Zea mays
aagaaaccaccgccgagcccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgctctggctgccatctaccaccaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgttttttttctttccatcgtggagaatttaagttattatccgtttgctgc

SEQ ID NO: 9469 - DNA, 1525 bp, Zea mays
accagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttctggtgtcgatttgcttctgagtttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttgttttcgtg

SEQ ID NO: 9470 - DNA, 1824 bp, Zea mays
cagaaaaattcctcccaccgcgacggcgacgagcacggggaccctccaccgcctccgcctccgcctccgcctcgccgcgtgcggcctccgcaccgccccgacgtcgacccctccgccctccccctcggccaccgacgcggcgccgcccgccctccgccgccgccgccgccgcggcgggctcggtctcctctggaagctcccctacggccgcgcgccgtcccgcccgatggacgcgctgccgcctctgcagcgcgccacgtcgccgccgccccagccccggccccagccgcccgtgccgtccaggaggtacggcgtgcacttctcggcgtccagcttcatccaggcgccgctcaccacgctgctcgagtactccggcatcctccgccccgatccaggcggcggaacccagcaggatggggccggggctgggccgggcgaggtgtcgatccggattgtggcgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcatcgtaccagcggtacgacatacagcaggtggccaggtgggtggagcagatactgccattctcactgctgctgctcgtcgtcttcatccgacaacatttgcaaggtttctttgtgacaatttggattgctgcggtgatgttcaagtccaatgatatcctgcgtaagcagactgctctgaagagggagagaaaaattccagttcttgtcgggattacaatattatttgttgttcacgtatctgggttttattggtgttacaagaacggggaccttataagacctctcatgatgcttcctccaaaagaaataccaccattttggcacgcaatattcatcatcttggtgaatgatacaatggtgcgccaaactgctatggttgtcaaatgtttgctgctgatgtactacaagaacagcagaggccgtagctatcgtaggcagggtcagatgctgacgattgtggaatattttctacttttgtaccgcgcattattgcctacacctgtgtggtaccgttttttcctgaacaaggagtatggaagcttattttcgtctctaaccactggcttgtatctcactttcaagttgacatcagtcgtggaaaaggttcaatcatttttgacggcattgagagcgttatctcataaagacttccattgtggctcatatgcaacaagcgagcaggtggctgttgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcggtgacggttcaacaagcctcttcttccagctattctaatctgagagagccaaaagagctgggcaagctggggcgctccaccctgtgcagatgttaggtgtgtgtgtgtgtgtgagtgttgctgctggcaacgcgtgcgagcagtgcggccctgatgcggtgctgggagagtgtacaccgagctgaagctgaaggcgtacatggttttgtattgtgattgtgcatattttcatcccatgtataggcactcgcgggatgcttgagcacctgaggatttttacctgaccttatacgcacaaactactacgtaaatagaaatggtgagtatatacaatggttccggatgcgtcgataaaaaaaaacgttaa

SEQ ID NO: 9471 - DNA, 3413 bp, Zea mays
ctgtcctcggctcctgagcactcgcgtactcgctcgtcgcatctgcccacactaccactggccacaccgaaaccctagctgcgcacccaaatcgatcgatccagggacggcagcggcacgacgcgccaaaataggttcagaactagcgtcgcgacaaaatcggttcacgaccgccacggttggaccagctgcgccgtggccgtgcggctgtgcggccggcattggcgcgctgcgcgctgcttcaggccggtgtgccgcgcggctgggcgacgtgaaacggattcacatcgtaggagcagaacttgctggtcgaggtggaggcttgctgcgtgcagcaggacagggagtcagggacaacagattttagcaaagtatgagctgtgaactagtgttagaggaaagcacgaaggaaatagtggcataaaacttgatttgtctaaagataaattggtttcttaaaatggctcagcaaatggcttcagttcatttgaatgatacaacagttgttgatgccaagcccttgcgtacattgactcccatgttccctgcaccactagggcttcacacgttcactcctcagaactcaccttcagttgtttgtgtgaccccatttggaccatatggtggagggactgaattggggatgcctgctgttccaccaatgtttgcagcgcctgtacctgctgcaggagcagaacccagccagagacagccgcatacagctaatatgaacggaggagacactgaattggggatgcctgctgttccaccaatgtttgcagcgcctgcacctgctgcaggagcagaacccaaccagggacagccacatacagctaatatgaacggaactgcagtcaacagttcggtcacatctttgcaaactccttcagctgccacacaggaatctggtaagaggaagaggggcaggccaaagcgtgtgcctgatactactgtttcttcggctccttcagctcctctggctcctactatttctccagttccttcacttcctgtggttactccagttccttcagctcctcaggaattgaacactattgtttccctgacgccttcttcagacgccccacaagaatctggcaagaggaagaggggacggcccaaacgtatacaagacgttcctgtaatggttcctctgacctcgcaaggagatagcacatctgttattcagacacttccagggtccagtgtacatgaatctggtacgagaaggggacgtcccaaacgtttgcaggatagttcagatattgtcactccaattgactcaaaagatagtgagtcctctccccagccacctattgccgcacctgccgaaagtggtaagaggaagaggggacgtccaaagcgcattgatggttccgtgactccttcaagtcattctgttttttcaatagatgatgatgctgttgacacgatgaaacgtggacgacctaggaaaattgataccaaactgttacagtttccatctttattttcagatgatcctagacaaactgcagataatgtactcatgatgtttgacgccctgcgacgcagacttatgcagatggatgatgtgaaacaagctgcaaagcagcagcctaacttgaaagctgggagcatcatgaacaatgctgaacttcgtgtcaataaggacaagaggataggagaggttccaggtgttgaggttggtgatatgttctacttcagaattgagatgtgcttagtggggttgaatagtcagagcatggcagggatagattacatgtctgccaagttcggtaatgaggaggaccctgtagctattagtgttgtgtcagctggtgtatatgataacactggagatgatccagatgttctagtttatactggacatggcatgtcgggtaaggatgaccaaaaacttgagaggggtaatcttgcactagagaggagtttgcatagaggtaatccaatcagagtcattcgtagcgtaaaagacttgacttgtccaactggcaagatttacatatatgatggtctttacaagatcaaagaagcctgggtagagaaagggaaatctggtttcaatgtgtttaaacacaagttgcttagggaacctggccaacctgatggcattgcagtgtggaagaagactgaaaaatggagggaaaatccatcatctagagaccatgttatattacttgacatatcatatggtgtggaaaataaccctgtctgccttgtaaatgaggttgacgatgaaaagggccctagccgcttcacttatacaactaatttgacatatgggaattctctcagctcgatgagaaagatgcaaggttgcaaatgcataagtgtatgcctccctggtgataacaactgctcctgtacgcatcgaaatgctggtgaccttccttacagtgcttcaggcatacttgttagccgaatgcccgttttatacgagtgtggtgattcctgcacatgttcacaaaattgccggaaccgagttgtacagaaaggtacgcagatccgttttgaagtttttaagacaggagatcgtggttggggcctccgtagttgggatccaattcgagcaggcacatttatctgtgaatatgcaggtgaaatcattgacataaatagagtgaatggtgaagatgactacatatttgagacttctcctttagagcagaatttaagatggaactatgcaccggaattgctgggtgagcctagtctttctgactcaaatgaaacaccaaagcagctgcctatagtcatcagtgcaaaacgaaccggcaacatagctcgctttatgaaccacagctgctcacctaatgtgttttggcaaccagttctgtatgatcatggtgatgagggatatccacatattgcattctttgcaattaagcatattcctccaatgacagagcttacctatgattatggtcagaaccagcgtaatagtattcaaatgggaacccattctggttttcggaagtctaaaagttgcttatgttggtccccgaagtgtagaggttcctttggctaataaccagccctataaggaatatattggatcataatactccatttcaaagttacacctaagatatctgctggtcgacttttatattcagctcccaaaaatctgtcacaagtttgtgagagcaactgaattgtctttaccagcagaagcagcccgccatggtggcctgtatgaagcagcaggggtctcctatgtcctaggtgttccatgcaccatcgaataaatccacccctcttcatgttagaatgggaaacggggatgtgttttgcacaaattatctgtcatgcagtcgtcgtattaagttttcttgaactagtttgtagtcatcctcagagaatgcatgatgtgcactttgtagtaatatatgcaggttgttatcccacct

SEQ ID NO: 9472 - DNA, 1023 bp, Zea mays
caaagattccgttctcccagtcgcctctcccagtcccagatctcgttcactcgcactcgcgcaaccccgcggccccgcgcctaatggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggcctcaacggcctcctcacccccgagcagttcctcgaggagcgcgagagcatgctccaagcgctcttcccatcctgtaccaagctgccaggagtactacgtttggtgcatcatcttcatgccaacggagtaccaatggctgttgcgacaggatcccataaacgccattttgcactgaagacccagaatcaccaggaaatgttttccctgatgcatcacgttgtcatgggtgatgatccagaggtgaaggctggcaaaccatcccctgatatttttcttgctgctatgaggaggtttgagggcggcgtagaacctagcaagtgcttggtttttgaagacgctccttcgggtgtagctgcagcgaaaaatgccggaatgtctgtagtgatggtcccggatccaaggctggatgtttcgtatcacaaaggagctgaccaagttctcagttcattgctggacttcaaacctgccgaatggggcttgccggcatttaaagagtagacattccatacaagataacaagattataagagtctagtgaagaagaatgtgagatactccctaagatgcaaattaaagagtacaattctttaagatgctgctcaaggaaaattccataaaatgttggtcaaacatacaattgaacattcttgtcgcctcctaactatgtgtcaccaaattactctgaataagttcgttccgattccgatataat

SEQ ID NO: 9473 - DNA, 1791 bp, Zea mays
gcctctcctcctctcccctgccctcgcaaacgcacgcaccacagcatcgtccttcgttccattcccatccataccccctcgatcggccgggatgctgggtgtggggatggccgcggcggtgctgctcggggccgtggcgttggtgctcgcggacgccgctgcgaggagagcgcactggtggtacagggaggcggctgaggcggtgctggtcggcgccgtggctttggtggtggtggacgccgcggcgcggagggcgcacgggtggtacagggaagcggcgctgggctcggcgcggcgggcgcggctgccgccgggggagatggggtggcccttggtcggcggcatgtgggccttcctccgcgccttcaagtccggcaagcccgacgccttcatcgcctccttcgtccggcggttcggtcgcacgggcgtgtaccgaagcttcatgttcagcagcccgactgtgctggtgacgacggcggaggggtgcaagcaggtgctgatggacgacgacgcgttcgtgacggggtggcccaaggcgacggttgcgctggtcgggccgcggtcgttcgtggcgatgccgtacgacgagcaccggcgcatccgcaagctgactgccgcgcccatcaacggcttcgacgcgctgacggggtacctgcccttcatcgaccgcaccgtcacgtcgtcgctgcgcgcgtgggcggaccacggcggcagcgtcgagttcctgacggagctgcggcgcatgacgttcaagatcatcgtgcagatcttcctgggcggcgcggaccaggccaccacgcgcgcgctggagcgcagctacacggagctcaactacggcatgcgcgccatggccatcaacctgcccggcttcgcgtaccgcggggcgctgcgcgcgcgccgccgcctcgtggccgtgctgcagggcgtgctggacgagcgccgcgccgccagggccaagggggtctcgggcggaggagtggacatgatggaccggctgatcgaggcccaggacgagcgcgggcggcgcctggacgacgacgagatcatcgacgtgctcgtcatgtacctcaacgccggccacgagtcgtccggccacatcaccatgtgggccaccgtgttcctgcaggagaatccggacatgttcgcgagagcaaaggcggagcaggaggcgatcatgaggagtatcccgtcgtcgcagcaggggctgacgctcagggacttcaggaagatggagtacctgtcgcaggtgatcgacgagacgctgcggctcgtcaacatctccttcgtctccttccgtcaggccaccagagacgtcttcgtgaacggatacctcatccccaagggctggaaggttcagctctggtaccggagcgtgcacatggacccacaggtgtaccctgaccccaccaagttcgacccgtcgaggtgggagggccactcgccgagagccggcacgttcctggcgttcgggctgggcgccaggctctgccccggcaacgacctcgccaagctggagatttccgtcttcctccaccacttcctcctcggctacaagctggcgaggacgaaccctaggtgccgggtgaggtacctgccgcacccgaggccggtggacaactgcttggccaagatcaccagagtcggtagctagctgctagattgtgatggaagtacgaatgaaaaaaaagcccagcagaaaactctagcggctgggccggctggaaattatgggccgggccattgtggttgcccccccctgtctgtgcaaaaataaaacaagcagaaaggaat

SEQ ID NO: 9474 - DNA, 1120 bp, Zea mays
gcgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagcttttaaagtcatcgcattcttttttgattgc

SEQ ID NO: 9475 - DNA, 1113 bp, Zea mays
ctagcatccgcagttcccccgcgcccgagacgcaaccccgcgccaggagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgctgtcgaagctgaagctgtgccgtgctattattgtagctgatttcctgttccctcactttttttttatattagtaggctggtagtgttcgaattagttccccattgctttgtgttgccgctagctgtcactaagtccgtgtggactggtattattcactggatttgagaagcatgtcagtggttgctctagcgttttattgagttttgaagtc

SEQ ID NO: 9476 - DNA, 1135 bp, Zea mays
cgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacatgcctagaagctagtacctagtgtttgctgctgtctaatgacattatgcaatgtgatctggaccctggtttcttgggtgcgacgcttgtagcagccgtcttatgattatttgtcgggaaaatttgggggctccccatatgagatgctgccgggcaagacctcgccatcccccacctcgtttcaggcgggggacgctggagcctggtccggttgggttgggaagccccttaaactgttgtcgcttgcattttaaccttttcatcgccgttcagtggtcct

SEQ ID NO: 9477 - DNA, 1399 bp, Zea mays
ctcggtcaagttactgatgcaatagctgattgttcacttgccatggttcttgatacaaattaccccaaggcaatttcaagatgagccaccttatacgagatgataagggattatggacatgctgctaatgatttaaggaagctaatctcacttcttgaaaagaaagtaaatgtgtctggaatatcaccaaaagcttttaacaagcataaagatatcaagcaagcacatgcgaggctttcacacatacatgctgaagcaaaaaacgatacccccctgaatttgtatttaatcttgggagtggagccatcctgctcttcagcagatattaagaaggcataccggaaagctgcattgagacatcacccagacaaggctgctcaattattagtaaggaacgagaatgctgaagatggattttggagggatgttatcaaggaagtctatgcagatgcggatcatctgttcaaaacaattggggaggcatataatgttctttctgacccggacaagcgtcaagagtacgactttgaagagaatctaagaaatgctcggagagtatcgagctcaaggagcatgcgtaggtcacctgaacataactacagcgacagaggctttaatccacggcagtggcagtcaagcagagcatcacgttggtacagcaaatcagacgattactggtaaagaagccactacggcgtggtcatgtggtgagaagcaacttttgcaactatgtcatgtgtggagcaaatgcctccttgcaccaaagatgggatgggatgcacctgccttcccgggttgtttaggtgccggtgctaatgcaccagccttgcagtcagcagctttcctgtttgtttgctgcgtttctttttcagaggatggaaatattaggattgatcaattggggatctgggatgattgcttgacactggtagcgtcgtgacttgactagcacagcaaatatggaggattaggaagtggtatatcaaatagtcttttgttggcctggtgatgtctgaacactgactgcttgggagtggctggcatgatgttatccgctctgaagtcaaaacactgagaacaacatcaaaggttagaaatctgggtaaagatgccagtttgtccaataggtacaggcattcttttgctgaatgcagggcccgctgtcgtaagtttacagcagatcagctgaaagaaaagagacaggttcttctgtttggcgcgtgcgcgtgcagttttgttctgttgtttccttattaccaaatgatgtagcgttggaaagagttggaacatattgtaactgcccaatgttgaaatctcgtaacatttatttattctttattactagacttgttagccaaatgttggaagcattttaaggtaatcaaggttccttcaaagc

SEQ ID NO: 9478 - DNA, 2974 bp, Zea mays
ctactggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgtccgacacgcccaagggcctggaggacctgaggaagaaggacctgcaggcgcttcggggcgacggccacggcgagcgcaaggcgtccgagcgcgtctacgactacgacgtgtacaacgacctgggcgacccggacaagaaccccgcccaccagcggcccgtgctgggcggcagcaagcggtacccgtacccgcgccgctgccgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagtccgccatcaccaaggagatcctggagaagcacatgagcggcggcgccgccatgaccgtggagcaggcgctcgcggcgaagcgtctgttcatcctggactaccacgacgtgttcctgccctacgtgcacagggtgcgcgagctgccggacacgacgctctacggctcccgcaccgtcttcttcctcacggacctgggcacgctgatgccgctggccatcgagctggtgcggcccaaatcgccgacgcagccgcagtggaagcgggtgttcacgcacgggcccgacgccaccgacgcctggctgtggaagcttgccaaggcgcacgtggtgacccacgacacggggtaccaccagctggtgagccactggctgcgcacgcactgctgcgtggagccctacatcattgccgcgaaccggcagctcagccggctgcacccggtgtaccgcctcctgcacccgcacttccgctacaccatggagatcaacgcgctggccagggaggcgctcatcaacgccgacggcatcatcgaggagtccttctggccgggcaggtacgccgtcgagctcagctcagcggcgtacggcgccacgtggcagttcgacacggaggcgctgcccaacgacctcgtcaagcgtgggctcgccgtgcgccgggacgacggcgagctggagctcaccatcaaggactacccctacgcgcacgacgggctcatggtctggaacaccataaggcagtgggcggccgactacgtcaacgtctactacaagtccgacgaggccgtcgccgccgaccccgagctgaaggcgttctgggacgaggtgcgcaacgtgggccacggcgacaagaaggacgagccgtggtggcccgtgctcgacacccgcgacagcctcgcggagacgctcaccaccatcatgtgggtcacctccggccaccactcggcggtcaacttcgggcagtaccacttcggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggagcccatggtgaaggcggcgttcgagaagttcggcggcaggatgaaggagatcgagggattcatcgacgagtgcaacaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaataaaaggtctcgtctgtactattgtattgtaccatggatcatatcgtacatgttgtgtcaatgcaaagaggcacgtttgagttaccatt

SEQ ID NO: 9479 - DNA, 2042 bp, Zea mays
aaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcttccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttc

SEQ ID NO: 9480 - DNA, 1146 bp, Zea mays
ccacgcgtccgcggacgcgtgggcgtcgcttccgctccacaggatcctctgcgccacccacaaccgtgtgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcatacaaggacagcactctgatcatgcagctcctgcgcgacaacttgaccctatggacttccgacaccaacgaggatggcggcgacgagatcaaggatgctgctgccccgaaagaatctgcggagggtcagtaagatggattcagtctcacgacctgctgctgctgatgttgaggagtaaccagaaccagaaccgccgtcctcgattctgatagattatcttctagtataccttgtgttgttgctgttgtcgtcgtcgcgccggtgtatgcgatgaagctgccattgctgctgttttaattaagcattctagatgttaaaaaaaaaaaaaaaaaag

SEQ ID NO: 9481 - DNA, 2486 bp, Zea mays
tagcgatctagtctcctcctcttcatcccacctcttcctccctccctgcttcgctgttccctttccccgcccctacctggggcatctgcctctgaatcgcggcggctcccgaggcgccgcctggcgagcgtctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggaattaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtcccaggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaatcaaaggaaacaagcaccatgaagaaagagaaatagcatttggtcaacccatatacaagtgtcagaataatgcatatggtgcattccctcaaaacagcccagcagttggaggattgcaaccttttgcagcttggcccaataacaaagttggtatgactgattcaacaagcacattgggaaatgtgggcaattctcaaaatagcaatatgctattgcatgaattgcagcaacagccagacaccttgctgttaggaacccttcacaatattgatgccaaaccttctggtgtagttatgccatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacagcattggaaacagtggagacatagtgaaccacgacatatttggatttagtggacatatgtgaaactttcttgaatttgtaagtagcgttgatcagtgagcactggaaacaaatctagtggtttgatgaatggttgctagtaatttcgtttcttttttttttcttctgtaattggtttataaagggaataatctatgtggcagcatgtggaatcttactttatagaagtttgttcagttcaaaggacttaaaattggtcagtcccttgtc

SEQ ID NO: 9482 - DNA, 1659 bp, Zea mays
cttcttcctcctcgccctcgtcgcggagcggagtggaggcgcgcgttccgggacggcacgggacaggagcggaggaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacaccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttacgtatcagaaagtgctctggaggacagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagca

SEQ ID NO: 9483 - DNA, 1295 bp, Zea mays
caaatatgggcaggcactagctagctaggctgcaaagagccaaagactgccggcaccgctgctagcttgctagcatacttccggtcggcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcggggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaatgtctcctccatcgccagcgtccttggcttcccgcaggaagtcatgtacagcgtcaccaaaggaggactgaatcagatgacgaggagcctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatatatagcgaagaataaatgtggatctattctctattctactgtatttgaatttgttttcgttcttgtcttcttgatcggccatgtatcaccgtcagacgtcagcggcaataatccggccgccgtcggcttgccgggagggagatacccaactagcgacatgcaagctgcccgatcagtcgtctcgtctcgcctcgccggccggcaaggtgcagccactgtcgttgcctgcagttctgttcctttttctactatggtttcttgtattcactgccccctggtgatgtttctgtgataacgacttcgacagaggggatacattttaaaatccttgtgctaatcattttttgtgcacatcagagttttttgagaacag

SEQ ID NO: 9484 - DNA, 2724 bp, Zea mays
gtaaattcatccgtccatccaccgacccagagccctcgatcccctaaaaaaaacccagagccctccattccacagccatcctcccctctgcagtgcactgctgcttgaccaagcaacaacaagaagctaccagcgcgctacctgcagattgcagcacacgcaagtgagagggcaggcaactccccggacgcaaggagttagagggcaagcatggcttcccttggtgacataggcctcgccgcgggtctcaacgtattgaccgccgttgccttcttgctcgcatttgcattccttcggctgcagccaatcaacgacagggtctactttcctaaatggtacctcaggggaatgagagacaatccaatcgtatctggtgcagctgtgcaaaagtttgttaacttagacgccagatcctacttgaagtttttaaactggatgccagctgctctcaagatgccccaggatgagctcattaaccatgcaggccttgattctgtggtctacctacggatatacgtaacagggctcaagatatttgttccaattacagttctggcttttcttgtactggtcccagtcaattggaccaatgacaccctaggacgcatcaacgtagtctacagtcctattgacaaactttcgatatctaatgtacctaatgggtcgaagaggtttatagctcacttgggcatggcttatgccatcacattttggacctgttatgtactgttgaaggagtatgaaattatttctaacatgaggctgcgctttctagcttcagagaaacgccgaccagatcagttcactgtccttgtgcggaatataccaccagatcctgatgaatcaatcagtgagcttgtggaacatttcttccttgtcaatcatcctgatcattatctacaacaccaggtggtttacaacgcaaataaacttgctgatctggttgaaaagaagaagaagatgcgaaattggcttgactattacctactaaagtatgagcgaaattcatcattgaggcctaccacaaagactggctttcttggatgttttggttccaaggtggatgctattgactattacaaatcagagatcgagaaaatcgggaaacaggaagctgaagagcgtaagaatgtcatgaaggatccaaaatcagttgtgccggcagcctttgtctcatttcgctcccgatggggtgcagcagtctgtgctcagacccagcaaacaagcaatccaacactctggttgacagaatgggctccggaacctcgtgatgtttattggaataatctgtccatcccatttgtgtcccttacaattaggagattgatagttgctgtggcattcttcttccttaacttcttttacgtcatcccaataacattcgtacagtctcttgcaaaccttgaaggaatagagaaggcacttccatttctaaaacccttgattgacttgccattcattaaatcattcatccaagggtttcttcctggaattgctttgaagatcttccttatagtgcttccaactatactgatgtttatgtctaaatttgaaggactgatatcgcagtcatctctggagaggcgatctgcatctaagtattacatattcttgttcttcaatgtatttttggggagcgtaattgcaggatctgctctggagcagcttaaaacttatctccatacatcagcaaacgacataccaaggatcattggtgactccatcccaatgaaggcgacttttttcataacatatgtgatggttgatggttggactggaatagctggtgaaatattgagactgaagccgcttatattcttccatctgaagaactttttcttggtcaaaaccgaaaaggacagagaagaagctatggaccctggcagtatctgctttgactcaactgaacctagaatacagttgtacttcttgcttggccttgtttatgctgcagtgacgccgttcttgcttcctttcatattggtgttctttgggttcgcatatgttgtcttccgccaccagataataaatgtctataatcagcaatatgagagcgccgcacagttctggcctagcgttcatgggcgtataatcacagcgttgattgtatcgcaactgctgctcctgggactgatgagcacgaacgactttgagcagacgacacctgtgctccttgttcttcctgtgctgacctttgggttttacaagtactgcaagaaccgctttgagccggcattcgtgaggaacccgctgcaggaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttgttcatgtcacaggggacacacacacacagatagaattcaagagagctgtggggaggactgaggggagagatagtttactgtagcttggacaaagaatctgaatacagcagttacattatctgatg

SEQ ID NO: 9485 - DNA, 2184 bp, Zea mays
tgggagttgggatacctcggaggcggcgacgacaggatcgcagtggtcagtagccgggtcggccggtggccgcagattctcaccagcagcgccatccctcgccgtcgcccggcgctccagcccagtctactactcatgcaagaagaatcgttcacaccctgaagaacaagaatcggtgtgtatttgcagggcaggagaggaagccactctgactctgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcctactatggcatgagcaccaacctggtgaactacatgaagacccggcttggccaggtgaactctgtcgcctccaacaacgtcaccaactggcaagggacgtgctacatcacgccgctcatcggcgccttcttcgccgacgcgtacatggggaggttttggaccatcgccatcttcatgatcatctacatttttggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacactatcagcgtcatcgtctgggtccccgtgtacgaccgcgccatcgtgcccctggtgcgctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctcggcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgcagtgctcagcctcctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtctcgggggcgaattggttgtttacatgtcatgtgtttatatatgcgcaatgttcgatctt

SEQ ID NO: 9486 - DNA, 1938 bp, Zea mays
cctccattcccttccctgctcctctaccccttcctctcccggcgaccagctggcctctcctttgttgaggcgagagacccccacccgatccggcgatggacgccgcgtccaggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcagaagaatgggtgtatgtctttaaaagggaccgtgaagggaagatatcctggtatgcctttgatccactccaccagctatggaagtcactcccaccagttccacaagagtattcagaagcattgggctttgggtgtgccgttctgagtggttgctatctgtacttgtttggcgggaaagatcctttgaggggttctatgaggcgtgttgtattctacaatgctcgtacaaacaaatggcaccgggctccggatatgatgaggaaacgtcacttttttggttcttgtgtaataaacaattgtctctatgttgctggaggagagtgtgaaggaatacagagaacactgcagtctgcggaagtttatgatccaaataggaacagatgggcctgtgttactgaaatgaacaatgggatggtgcctttcattggagttgtatatgatggcaagtggttcttaaaggggctagattcccatcgccaagtaactagtgaggtctacttaccatcatccaatacatggtcagcaattgatgatgagatggtcacaggctggcggaacccaagtatttctttcaatggccgtctctattcagctgactgccgggatggctgcaagcttagagtctatgatgagaacacaggaacatggacaaggttcatggacagcaagcaccacttgggcagctcacgtgcctttgaagctgcagctttggtgtcgctaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttgagggcaggttttgttagtgggaacatgatcaagttttttaagaagcaaaaggttcagatcagtgacagaaccctccatttcgaaggtagtaaggtttcattgcagaatcgcggggaaaaaggtcattggcgtgccactgctgcccccaaagtcccaaatagttatttgctctcttccagaactgaaaattccaattactttctggcaacatttgaagactcttatcattaatggataaggtttttcagattttgagtgcaaaccagaaagtgagtaggaacttccctagtgtaatgacattttccccttgctggcaggctgggaaatgtgtttggtggatatattggtctcttatcatatttatctatctttgcatcgtgtaatatgtggcatcttactgtgtaatgttggtgtatattgtagtggcggactagctagactccagggttagagtagtcaggattatgcctagtatgcttcaatttttttgttggtccgttcataaatatatgacgccattgacgtttttt

SEQ ID NO: 9487 - DNA, 1605 bp, Zea mays
cctttgcgtgaagagagctaggtgggccgtagaaaaggcttcagttcagatctcatttcagatagcacaggaccaatctggtctgcagtgttcaactggaatataagatttcgctgcataggtcaaagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtac

SEQ ID NO: 9488 - DNA, 2047 bp, Zea mays
aaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttcgagtt

SEQ ID NO: 9489 - DNA, 1228 bp, Zea mays
ccagcaggaacggtgaacaaaatatacacattgcagatatgctacttatacacagtggtaaaaaatacggcaaaccgctgctgctgcttctcgcgatcacgacgatactgcaccaggcggagaagcggggacagtccggggtccggggaagacttgctggattttgggctatcacatcgcgacggtgagggcaaaccttcagcagctcagatggctaagcatccatggtggcagtccaacgcgagcctgcggctgcgctgctgccccttccaccaccctcccgcctgctgccacagggaagatgctgacatttgttgttggggcagcttcccttaacatgaaggacgtggaagacgaactggtctgctgttgagtttggtcccgttgcacttgctgccgctggtctttctgcttctccgcgagctccttctgcagaaccttgttctcctcctgcagtgacttctccttccgttggagcgctgaaattgactcgaccataagctggctcttccttgttctgatatgtttcagtgaactctccagctgctgctctagttgctgaagctctttgagattcaaagtttcaagatcctctcccatgaggtgcttttgacatttctgtattgtctcgaccttcgcctttagttttctatattcatggcaccaattgccctgagtttcatattctgcggaaatgagaaccttttctgcataggagtagcgctcataccgttcaagaattttgtccatacatgaatcggtagagtactcgtagagcttgcccttggtggagaagatgatgagcgcgacctcggcgtcgcagagcacggagatctcgtgcgccttcttgagtagccccgagcggcgcttggagaatgtcacctggcggttgatcttgttctcgatccgcttcagctgcaccttcccgcgccccatcgccgccgccttctccctctcctgatctcaacctaaatcctagctcaggcacgtcgcttcagccgccgccgccgacagcagctataaaactagctagcttccttccttgttgcttgcgagaggcttgcttgacacaggataggtaagcctacggctggctaattgtagatagtatgcggtggcggtggcgccggcgagtgcatgacgtcgcagctagctgcggcggtggagagatagggggagggcccacgcgtccgcccacgcgtccgcccacgcgtccgcggacgcgtgg

SEQ ID NO: 9490 - DNA, 2000 bp, Zea mays
gaacgacctgtccggcgggatccccgcgcagctcgcgcggtgcgccaacctgacgctgctcaacctggcgtacaaccgcctcgccggcgaggtgccggatgttctcggcgagctcaggagcctgcaggagctcatcgtttccggcaacggcctcggcggcgagttcccgagatcgatcctgcggtgccggaacctcagcaagctggacctgagctacaacgctttccgtggagacttgccggagaacatctgcaacgggtcacggctgcagttccttgtgctcgaccacaacgagttctccggaggcatcccagcagggattgggggctgtacccggctgcttgagctgcagctcggtagcaacaacctcagtggcgaaatcccagccgagataggcaaggtgaagagcctgcagatcgcgctgaaccttagctccaaccacttcaccgggccgctgccccgcgagctcgggcggctcgataagctcgtcgtgttggacttgtcgcgcaacgagatatccggccagatcccaggcgacatgagagggatgctgagcttgatcgaggtcaatctgtcgaacaaccggctcgcgggcgccataccggtgttcgggccgttccagaagagcgcggcctccagcttctccggcaatgccgagctgtgcggcgacccactgaccgtagactgtggatcatcaatctatggctccagctatggaacggagacggaccacagggggatatcttacagggtggccttggcagtcgtcggttcctgcgtgctcatcttctcactggtgtcgttgctggtggcgttgttcatgtggcgcgagaggcaggagaaggaggaggaggaggcgaagaagaaggcggaggaggtggcggtggcggcagcagccccacaggtggtggcctcggccgtgttcgtggagagcctgcagcaggccatcgatttccagagctgcgtgaaggcgacgttcaaagacgagaatgaggtgggcgacgggacgttcagcaccacctacagagccgtcatgccctccggcacggtggtgtcggtgaagaagctcaagtccgtggaccgcgcggtcgtccagcagcggacgaaggtggtccgcgagctggagcgcctcgcccacatcgggcacgagaacctggtccggcccatcgggtacgtcctctacgacgacgtcgcgctgctgctgcaccagcacctggcgaacggcaccctgctccagctgctgcacgacaacggcgagaggcggaaggctgactggcccaggctgctgtccatcgccgtcgacgtcgcccaggggctggcgttcctccaccaggtggccaccgtccacctcgacgtctgctcggggaacgtgttcctcgactcgcgctacaacgcgctgctcggcgaggtcgagatctccaggctgctggacccgacgaagggcacggccagcatcagcgcggtcgccggctcgttcggctacattcctccagagtatgcgtacacgatgcgggtgacggtgccgggcaacgtgtacagcttcggggtggtgctgctggagatcctgacgtcgaagctgcccgccgtggacgaggcgttcggcgagggcgtggacctcgtgaagtgggtgcacgcggcgccggcgaggggcgagacgccggagcagatcatggacccgcggctgagcgccgtgtcgttcgcgtggcgccggcagatgctggccgtgctcagggtcgccatgctgtgcacggagcgcgcccccgcgaagcggccccggatgaagaaggtggtggaaatgctgcaggaggccagggacagctgagtggtctggttcctctgctcaatgatgtgtggttggctgcttggaacttggaacttggaagtcgaggcgagaaactctgaactgatcatcgttggagttcgagtatggagtccatccggtagcgtttgattctctgtatatattcggtaattagtatcccgatcatgcgccatggatc

SEQ ID NO: 9491 - DNA, 2012 bp, Zea mays
gccttggtgttcacgccgtcgctagcgcctgcggcctgccgcggcgaagcttctgccctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatctacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgctattggggaagctgtggcatatgtcctgtctggaatgtatggcagtgtaagccaacttggaacagggaatgctatcctcattatacttcagcttttctttgctggcatcattgtcatctgtctggatgaacttctccagaaaggttatggcttgggatctggcatttctctgttcattgctaccaatatctgcgagaatataatctggaaggcatttagccccacaaccatcaacagtggtcgtggtgctgaatttgaaggggctgtcattgcactgtttcatctgttgattacgagaaccgataaagtccgtgctcttcgtgaggctttctaccgccagaaccttccaaatgtgaccaatttgcttgccacagtcttggtcttcctcatagttatctatttccaaggcttccgtgttgtgcttccagtgagatcaaagaatgctcgtggccagcaaggctcatatccaattaagctgttctacacttcaaacatgcccatcattctgcactctgcactgattaccaacctctatttcatatcccagcttctctacaggaagtacagtggaaacttccttgttaaccttcttgggatgtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaaaacgtggattgaagtttctggttcatcagcaaaggatgttgctaagcagctcaaggaacaacaaatggtgatgccaggacatcgtgagtcaaacttgcagaaggaactgaaccgatacatccccactgctgctgcatttggtggagtatgcatcggcgcattgactgtcctggctgatttcatgggtgcaattggttcaggaactggaatactgctggcagtgacaatcatataccaatacttcgaaaccttcgagaaggaaagggcaacggagcttggtttctttggtttttgattagtagttgtggaaccttgaactgatagctgaattttcttgtaaggccctgtttggaagcaacccggttttttagaaaccagtttttatattttagctaggagaggccaacttcatggtttttaagaaactgagaatctaatttctataaacttagtcataaactagtatgtttggaaccacctcaatttctataaaccagtttcttaaaaactgggtgtttccaaacagggcctaagtcactgtagtgcttagccagttgtaacttaagagagttctgttaggttgccttgtggccacaatcatgtagcagaatctgtccaaagagcgtgctcatcccatccacaatcagtaatccgcactctacagtttgctcataggttaccctggcaactggatgttctgtgttcaatttcagttacttttgaactgtaaggtctgttattactagtttcccagaacttagatgctcacgtgcgctttatttc

SEQ ID NO: 9492 - DNA, 2508 bp, Zea mays
agccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagtttgaggagaggcgaagacagccttttgtgccagggtttgacattgctgaaagtagtagaagaaaggctgatgccaagcagctacagggtagtaagaaaattgctgcagagaacgacagttcagacaatctgcgaggtgaatcagaaggttttactactgaacaagtagtaaaaccagaaggctctcatgttgtcggtcattcaggtgtttctgcgtatacagtcgggtccctggtccaaactgcttcactaggttctaggacacacagacagaaacacaaagaagtgaatttgggtactccaggagcatcgtcttcaactctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcaggaacatctttcattggaagaagtctccactgagagttcaataaggccattctttgtggaatttgataataacattttctcgtctagtcatcttcgtcgctcgagtactcgagctgaaaggggaagaccaagctccctttttgaagaaagtcctcgacaaatgttccatagtctcatgggggagagggacagacatagacacataaccatggaaggaattacagaggttgctttctaaaatgtttcctatactggttccagttgttctgttttcgttgttagatcttatgccattataatccagttaaatatatagtgatactggtcttgattttgataaatatccataactttgactacgatggtggtttaagtgtaacattttggaatgaaataggtttattttctgtaggttttggctgcattggagaggattgaacagcaagcagagctgacctatgatcaattgctaatgctggaggctaatctattttttggcgcctttgcctcctatgatcggcatagagacatgcggatggatattgatgatatgtcctatgaggaattattggccctggaggagagaataggctctgtgagcacagctctttcagaggagcagttcacaaaatgcctcaaaagaagcatatatagtcaggtcgctctagaagtgaacaaatcaaccgttgatgacatgaaatgcagcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataacttgatgaatggcctaagtcaaagagg

SEQ ID NO: 9493 - DNA, 1821 bp, Zea mays
agtagcaacaggagcgcaggcagaactagagcggtcttggtatggcttcttccctcgcgcccgcgtcgtgggcactgccgctgcagatgggcggggctggggcggcagcggcggggccttcctgccgcgcgacgctagccgtcgtcacggagccccgctgggccgcgtcgctgcgccgggcaagggttctcgtggcgctggcgccccggtgcgtggcgctcgacgggcccggcgccagcggcgaggaggaggcgcccaagatcgaggacgagaggaagaagagcggtgagacgaagaagccggcgcgcggccggccggtgtggagccggatcctcttcgcctccaagaagacacgaagtatcatcatcctcaacgccctcacggtcatctatgcaagtgatattccggttttgaaagaggtcgaagccctgacagagcctgcggtcttcaacatggtgcggttcgttgttgcagccatccccttcgtaccattcgcgctccgttccttcggtgaccgcagtgtacgctacgcgggactggagctgggagtctgggttagcttagcttacctttctcaagcaattggattgctctcatctgatgctggccgagcatccttcatcacggccttcacggtcgtagttgtgcctctaattgatggtcttcttggtgcttcgatccccagactcacatggttcggagccatcatgtctctgttcggaattggcctgctggaatgtggtggatctcctcccagtgttggcgatattttgaacttcttcagtgccgtgtttttcgggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggagttctttctacggtgttatgcatgtgggcagagatggtggcgatgggcgatgtttcagcaaccgaaactgcagttgtttacgggttggagccagtttggggagctgcttttgcttggttcctccttggtgaaagatgggatgacgctgcatggaccggagctgctctcgtattatgtggcagtttgacagttcagctatttgggtcagctcctgagaagtccaagaaagtcaaaaaacgcagcagcaatgctttagaaactccggtgaaacgacgagactacttatcgttgtctcccataccagttgattccgggaagatcataggaaggcaattagaaaggaagaacaaagcagtataggtagcccaactacaaggcaagaagaaaggaaacgctgcgatggtaggggcgcgcatgtaccaaatcattgtcctgaggcatcatctgtttggctccgtcaatatggggatgctgctcgattgctcctcatggggtttttttcctttgtccatattgaaaatggtcgtatttggatttctgttgtctcagttgaccgtgctagagtacctcatgcgtattaggaaatgaggcattggtagtggcaactcgaggagaatactgagacacatctactggcgtagtaatggcgttcagtgagataacttagtgtgttttgggcactgttaaccgtacaggttcatgtaaatatagtggctaaatggttctagagtactgagctgagcacaccattgtatagtactgaaataacaaataccacgcatggtattatttggct

SEQ ID NO: 9494 - DNA, 951 bp, Zea mays
accgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacgttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccacggacggcgcggcccaccagtgcgagagcttgaggagcagcagcagaaagctgcggtcggatcaggtcgccgcgcctgcccacagatcgcaaccgacgacgggattaaccatggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgccatgcggtattattagtgtaaccactaaggctccaggctttcagttcaattccccccctgtaatccagtcctggcatgaggagccaccagttcttgctcgccgctccctatatttccatttcacttttcaccagcttttttgtggttattattatttatttttttggct

SEQ ID NO: 9495 - DNA, 2137 bp, Zea mays
ctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggcgcctcggccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtgaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctcaggcccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccagtcgccgggaggagggagaaggccaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcttctgctgaataataatgaagacacgcatgcatgtcgtcgtcaggaacaagagaaataatacaagaccagcacgcatgggcatactctatattatagatggccaaaaagcacgaggcccgtgagcccggcacgaagcccgctttttgggcccggtccgagcacggcacggtagaataagcgggcgggcttgaacaggaaactaggcacggcgggctagcccggcacggcctgtttacctctaagcccgttaaacccgtttttttttacactaaaacgtgcttaccggcccgtttagcccgcttttcggcccgttatttcgtgctaaacgggccggcccggcccgtttaggcccgctgcgggccgggcttggacagaaacttaagcccgctggctcagcaggcccggcccggttttggccgggcttcaccggcccgtttggccatctctactctatatatatgtatagcccgtgcccgtgtccgcatttgtaccaatacaagccaagcctagtcaagtggatgtgtattattgttgcgctatcacatacatgtacccctgctacctgaagatggatgtgtatcgagttatcaaattaaggcaccagcagcaaacgctatatatatattgcat

SEQ ID NO: 9496 - DNA, 1329 bp, Zea mays; identical to SEQ ID NO: 1923

SEQ ID NO: 9497 - DNA, 2008 bp, Zea mays
cgaactgagcaagcttttcgacagagaacgtatccctgaacgtgttgtgcatgcacggggagccagtgccaagggtttctttgaggtcactcatgttttctccccccttctcgccttctccttctcccccctagtctagaggcgttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgtcgttgtacttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagctgtgacgttatgtttctgacagtttatttactaatgagcacatctttaatttactag

SEQ ID NO: 9498 - DNA, 1537 bp, Zea mays
cacctccacgcaactggaagcttcgcttcaatctgccctactcctccgccgcctccaacaccgcagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagtcgcagtcgcagtcgcagcaggagcagaagccgcagccgcagccgcagccctagataccgcaggagtccaagctatagtagaaggagctatagccctcgttatcgctctccaaggcgccgtagtccttcgccaactcgcgcgcgcagctatagcaggtcaccatagtacaactgcaacgagtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggcatgttctgcttaaacgactcggccaactacggctctcagttagtcttcatggttttgttcctccattcttggcacgtccttatctgcaaacaaatgtcaacgttccattactagctgccttcgatgtttcatcatgaaattcttcaccgaagatgcaacttcatcacaaattagtaacatcctttcccctcatatagttgataaggtttgagtgtactgagcactaacaaatgcagctcgcgaaagtaagaccccttttcgtcatagaacaagacagctattttaattgcagcactcgtgtgaaaatatatctactctgcatggtgggattggggcgattgaagtgtgtggccttcagctgcacctagttgggcatcccaggaacctagtcaggctgactacagcaagaggcgcatcctttgactaaacatgtttgttttatttcttgtggtttgattcttcacttctgttcattgtgttctgccttcactgcaccctattggattggtagtggtcgaacaatgcttctgtctgtggtaagttattcttggtacaatggctcttctttacccctgatcagtgtatgttggactttctgatagagttagcaccaattgtagtataaatatgttcttttttctctggaaggtaattgtaattctatctgaatactccgatttgagatataatctgctcttgtcaaatggttttttaaagatc

SEQ ID NO: 9499 - DNA, 1775 bp, Zea mays
gtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgcttctagatgaaattgacaagactggttctgatgtacgtggtgatcctgcatcagcactactagaagttcttgaccctgagcagaacaaagcattcaacgatcactatttgaatgtgccgttcgacctgtcaaaagtcatatttgttgcaactgccaataggatgcaacctataccccctcctctgttagacaggatggaaatcattgagctgccaggctacacacccgaagagaagttaaaaatagccatgaaacatctcataccaagggtattggagcagcatggcttgagtacgacaaatcttcagattcctgaggctatggtcaaactggtcatcgagaggtacacgagagaagctggtgtgcgcaatcttgagcggaacctagctgcattggctcgtgcagctgctgttaaggtcgcagagcaagttaaaactcttagacttggcaaggaaatacaaccaattactacaacccttcttgattcaaggcttgctgatggcggtgaagttgaaatggaagttattcctatggagcatgatatatcaaacacttatgaaaatccatctcctatgattgttgatgaggctatgctagaaaaagtacttgggcctcctagatttgatgacagagaagctgcagatcgtgtagcaagcccaggagtctcagttggccttgtctggacttcggttggtggggaagttcagtttgtggaggctacagccatggtgggtaagggtgacttgcatttgactgggcagcttggtgatgttattaaggagtcagcgcagctagctttgacatgggtgagagcaagagctgctgacctcaatttgtcacctacttctgatatcaacttattggagagccgtgatatccacatacattttcctgctggtgctgtgccaaaggatggcccttctgcaggtgtgacattggtaacggcactggtgtcgctttttagtaacagaaaagtcagagcagatactgctatgactggcgagatgactctaaggggccttgtattgccagttggtggtgttaaggacaaggtacttgcggcacatcgttatggaatcaagagagtaattttacctgaaaggaacttgaaggacttatcagaggttccattaccaattctctccgacatggagattctgcttgtgaagcgcatcgaggaagtactcgaccatgctttcgaaggccgatgcccacttagatcacgctccaagttgtagcacccaagtcgcgtttggtatggatgtttgcttgagaggatcatcgtcacagtaccacgaatggtcaacagtgtgagagtaagagcctagctctcttgccagcacaggtcttggcacgcccttttcggtttggcttcgcgtctggaatgtgtatacaggattactggtcagaattctgagaataacgagaagattctctgctgggatagtgggattccctgcatatttatgtgaaaccagctgtcggtatttatgcacagatgcaacagcaacacaaatctggtaggaacactggtgggtttctgtcgataatttgagtgtatatgtaatattatgtaatctattccaggg

SEQ ID NO: 9500 - DNA, 1490 bp, Zea mays
gcgggacacccgggcgcgtgcacgggagacgggagtatggacaagagcgcggtggcggcatacgacgtcgagcggggcgactacgaggaggagcacgaacggagagggacggtatggacggcgacggcgcacattgtgacggcggtgatcggctccggcgtgctggcgctggcctggagcgtggcgcagctgggctgggtcgcggggaccctcgcactcgccggcttcgcctgcgtcacctactacacctccacgcttctcgccaacgcctaccgcgcgccgcaccccgtcaccggcgacaggaaccgcacctacatggacgccgtcagatcgtacctcagtcccagggaggtgttcatgtgcgggatcgcgcagtacgtgaacctgtggggcaccatggttgggtacaccatcacggcgaccataagcatggccgcgatcaggcagtccaactgcttccgccggagcggcgccggcgcgcagtgcgacgcgccggggaccgtgctcatgctggcgttcggcgtggtccaggtggtgctgtcccagttccccggcctggagcacatcacctggctgtccgtcgtcgcggcggtcatgtccttcgcctactccttcatcggcctcggcctctcggtggggcagtgggtgtctcacggcggcggcctcggcggcaggatcgctggtgctgccgcggcgtcccccaccagaaagctctggaacgtgcttcttgccctggggaacattgccttcgcctacactttcgctgaagtgctaattgagatccaggacacgctcaagtcaccgccaccggagaacaggacgatgaagaaggcagcgatgtacgggattggagccactaccatcttctacatctctgttggctgcgctgggtacgctgcgtttggttcagatgctccgggcaacatcctgacggcaggcgggttgggtcccttctggctcgtcgacattgccaacatgtgcctcatcctccacctgatcggtgcataccaggtatatgcgcagcctatctttgcttcggttgagaggtgggctgcctcccggtggccggaggccaagttcatcagcagcgcgtacaccgtcagcatcccgctcatgcagagaggatcggtgaccgtggcgccttacaagctcgtcctaaggactgttctggtcgccgcgacgactgtggtggcgctgatgatacccttcttcaacgctgtgctggggctcctcggcgcattcagcttctggccgctcacggtttacttccccataagcatgcacattgcccaggacaagatcaccagggggaccaagtggtaccttctgcaggctttgagcatggtctgtttgatgatttcagtggccgtgggtataggctctgtgactgacattgtcgatagcctcaaggtctcttccaaccctttaaaaactgtaagctaaaggttattgtagtcacgtacaatacatataaaatctgctctaagtcg

SEQ ID NO: 9501 - DNA, 1505 bp, Zea mays
cgcttcttgttgccaaagaattccctcccctagccgccgccgccgctcgtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttcgagtt

SEQ ID NO: 9502 - DNA, 1662 bp, Zea mays
ggcggagatcgagtcgagcgcccgccacggcgatggcggctagagtcctgccgccgccgctcactctcgtactcctcctgctgctgctcccgctctcagcccgggacaccgtcgccgcgggcgaggatttcccacgcgacgggcgggtgatcgacctcgacgagagcaacttcgaggcggcgctgggcgccatcgacttcctcttcgtcgatttctacgcgccatggtgcggccactgcaagcgccttgcgcccgagttagatgaagctgcaccaatgttggcagggttgagtgagcccattgttgttgccaaagttaatgctgataaatacaggaaacttggatcaaaatatggagttgatgggttccctaccctcatgctttttatccacggtgttccaattgaatacactggttcgaggaaggctgatcagcttgtccgcaatctgaagaagtttgttgcgccagatgtttctatccttgagtcagattctgcgataaagaactttgttgagaatgctggtacaagctttcctatgttccttggttttggggtgaatgactcattcattgctgaatatggaaggaaatataagaaaagagcatggtttgctgttgctaaagatttctctgaggacgtcatggtagcctatgaatttgacaaggttccggcgctagttgcaatccatccaaagtataaggaacaaagcttgttctatggcccatttgaagaaaatttcttggaagatttcgtacgacaatcccttctccctttggttgccccaatcaatacagagacgataaaaatgttgaatgatgatcagaggaaagttgttctcacaattatggaggatgattcagatgaaaattctacacagctggtaaagattttgagatctgctgctagcgcaaaccgtgatttggtgtttggatatgttggaatcaagcaatgggatgagtttgtggagacttttgatgtttccaaaagctcacagctgccaaagctacttgtgtgggatagagatgaggagtatgagctcgtggatggttcagagagattagaagaaggtactgaccaagcatctcaaataagccaattccttgagggatacagagcaggaagaacaacaaagaagaaaatcagcggcccttctttcatgggtttcctgaattctctggttagcttgacctcgctgtacatccttatattcgtcattgcccttctgtttgtcatggtgtactttgctggccaagatgatactccacagccaagacgaattcatgaagagtgatggaagcttggggagtttcttgcacctgaagtgtaaagatggctaatgtaccaggagatgtagctcagaggttatagatttcaaactttcaactgacgcaagtcttgaagagtggatttggctattgatgctgagattcttcaatttctattggccacaccaacttctacatcctgcctatttatgtttctgctttgtgcccttcaatttgttctttaatttagagcttagaaattagcctctgcctgtgtattttagaaactgtccattccagagtccatttctgtgaaaatatatttttattatcatactccgctactgaacgtttgtacaattaatacaggatgtatagactgttctggtgctcgct

SEQ ID NO: 9503 - DNA, 1958 bp, Zea mays
ggaagaagaggggaggcgcgacaaaaagggcgccgcgcccccgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctgcccatcaacttcgatggactcgccaaggctttgacaccaggtgcaacgatatttgtgggccaatacttgttcactggtagcgagactacttcagtttggttggaggtttctgaagttaaaggagatgatgtggtttgtatcatcaagaacacagctaccttggctgggtcgctcttcacgctgcattgttcccagattcatattgacttgcccacgctgtctgatgaggataaggatgttatcaaaaaatggggtgctccaaataagattgacttcctctctctgtcttacacaagacatgcagaagatgtgcggcaggcacgtgagttcctctcgaaattgggtgatcttagccaaactcagatctttgccaaaattgagaatgttgagggtttgaaccattttgatgaaatactggcagaggcagatggtatcattctgtcaagaggaaaccttggaattgaccttccacctgagaaggtctttttgtttcaaaagtctgcgcttcacaagtgcaacatggctggaaagcctgctgttgttactcgtgtcgtggacagcatgactgacaacctcagacctactcgcgcagaggcaactgatgtggcaaatgcagttcttgatgggagtgacgccattctccttggtgctgagactctccgtggtttatatccggtggagactatttcaacagtgggcagaatttgtgctgaggctgagaaggtattcaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaagtacaggcccagcatgcctgttctatctgttgtcattcctcgtctaaagacaaaccaactgaagtggagtttcacaggtgcttttgaggcaagacaatcactcatagttagaggcctcttccctatgcttgctgatccacgacacccagctgaatctaccagtgctacaaatgagtctgtgttgaaggttgctcttgaccatggcaaagcctcgggcgtgatcaagtcccacgaccgcgtcgtcgtttgccagaaagtgggtgattcctctgtggtgaagataattgagctggatgattagacaatcaggctatgctgttgtctactagggcacgttttgccattttttttttgcctaggccgaaacttattggctatgtataatcctatagcgcttgaaaactgagcagtttttcctatggtgccatcataggatttgcttttacagttcaattatggtgtagttcgaaatttgctcgactaaactgcggtgtaacagttaaatgggcagatggataatgtaatcatactgttccctcgtt

SEQ ID NO: 9504 - DNA, 1555 bp, Zea mays
aggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccac

SEQ ID NO: 9505 - DNA, 1077 bp, Zea mays
cctttttctccactccgcttttgcttggttccatcgggccggagaggaggagctagctagctagcagcagctctgttggtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattcttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgt

SEQ ID NO: 9506 - DNA, 2047 bp, Zea mays
cggaagcgacccagcagcgaagcgacgactagctctgcggcctctgccccaagcgccgacgatgggtgccggtgctactgccagggacgaggagactgctaccggccgccaccatgggaggaagccgcatggcgcggcggcggagtacgcgcaggacgggtccgtggacctgcgcggcaatcccgtgctccgctcccagcgcggcggctggaccgcctgctccttcatcgtcgtgtacgagctgttcgagcggatggcctactacgggatctcgtccaacctcatcatctacctgacggacaggctccaccagggcaccgtcgaggcctccaacaacgtcaccaactggtccggcaccgtcttcctcacgccgctgctcggcgcctatgtcgccgacgcctacctcggccgctactggaccttcgtcgtcggctccgccatttacctcctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctgggaaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgcgaggaagcgtaagttcaggatggactccaccgacgccatggccttcctcaacaaggccgccgccgtgcccagcggcgggccggcggcgacgccggcgtggagcctctgcacggtgacccaggtggaggagacgaagcagatcctgaggctggtgcctctcctggtggccatgatcgtgccctgcacgctcatcgcgcagaccaacacgctgttcgtaaagcagggcacgacgatggaccggcacatgggcccacgcttcgagatcccagcggcgagcctgggcgcgttcgtgacgctgaccatgctggtggccgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggactggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgtcgtcaacttcgtcgccttcctcgcgctcagcgccaggtacaggtacaaggcccagtccaccgacacgatcgacgctgccgtcggcctggagaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtagcatcaactcacttgtaaaaaaaagcacaggatttccacccgaaaccaaaagcagtgtctgc

SEQ ID NO: 9507 - DNA, 1736 bp, Zea mays
ccacggtccacggaccacggctatgttccactccaggtggaggctgcagccccggtttcgcaagccgcgccgtggtttgcttgcccacaggcggccaaaccgcaccctccttcccgtcgtttcccatctcttcctcctttagagctaccactatataaatcagggctcattttctcgctcctcacaggctcatctcgctttggatcgattggtttcgtaagtggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccatgaggctggaggtatcatagagagtgttggagagggtgtgactgacgtagctccgggcgaccatgtccttcctgtgttcactggggagtgcaaggagtgcgctcactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacactgtcatgcatgtcggttgtgttgcaaagatcaatcctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaggaccacaacaagccagtgcaggaggtacttgctgagatgaccaacggaggggtcgaccgcagcgtggaatgcactggcaacatcaatgctatgatccaagctttcgaatgtgttcatgatggctggggtgttgccgtgctggtgggtgtgccgcataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtattcatgtgtttgtttgcttatgtgtttgtttgcttgt

SEQ ID NO: 9508 - DNA, 1024 bp, Zea mays
aaactgaaggccaaaattgagaccatacaaaaatgccacaagcacctgatgggagaggatctagagtctttgaatcccaaagagctccagcaactagagcagcagctggatagctcactgaagcacatcagatcaaggaagagccaccttatggccgagtctatttctgagctacagaagaaggagaggtcactgcaggaggagaacaaggctctgcagaaggaacttgcggagaggcagaaggccgtcgcgagccggcagcagcagcaacagcagcaggtgcagtgggaccagcagacacatgcccaggcccagacaagctcatcatcgtcctccttcatgatgaggcaggatcagcagggactgccgcctccacacaacatctgcttcccgccgttgacaatgggagatagaggtgaagagctggctgcggcggcggcggcgcagcagcagcagccactgccggggcaggcgcaaccgcagctccgcatcgcaggtctgccaccatggatgctgagccacctcaatgcataaggagagggtcgatgaacacatcgacctcctctctctctctctctcgtcatggatcatgacgtacgcgtaccatatggttgctgtgcctgcccccatcgatcgcgagcaatggcacgctcatgcaagtgatcattgctccccgttggttaaaccctagcctatgttcatggcgtcagcaactaagctaaactattgttatgtttgcaagaaagggtaaacccgctagctgtgtaatcttgtccagctatcatgtatgcttgttactgcccagttacccttgaatctagcggcgcttttggtgagagggtgcagtttactttaaacatggttcgtgacttgctgtaaatagtagtattaatcgatttgggcatctagtaactaaattaagggtgtgtttggtttggcttttgatttctaaaagacaaaagccaaactaaagagctggatccataaaatagcattttctaaaagtcagactttgtggcggtac

SEQ ID NO: 9509 - DNA, 1856 bp, Zea mays
cccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttaacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgtcgttgtacttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagctgtgacgttatgtttctgacagtttatttactaatgagcacatctttaatttact

SEQ ID NO: 9510 - DNA, 2665 bp, Zea mays
gttttaacgccacctcgcgacgcggcccccaacccccaccgctgcggtgctactgctaccgtgctacaccatcaggaatcggacgcgggacgctacaccaccaccacagctccccacctccaccctcgccgcgagttgctcagtcgcagactcgcagcgagcgaggcgggggcctcactcagcgcggggcgaggcgagcgtcccgggtgggcagcgtcgcggtcgcgggctcgatcgggttgggacggggaggtagggaggaggggccagggatctccactctcgtccgtgcgggagcgcgggcgtcgcatgcggcggcgcgccggggcaaatgctggtagcctcacgggcggaggagcgctcacgctgaggcggcggccggggagcgatgcaggcgccggagcagcagccgcagcagcagcagcagcggaggaagggttcgtcagagatggacttcttcagtgaatacggcgatgcgaacagatacaaaatccaagaggtcattggcaaaggaagttatggcgttgtttgctcagctgttgaccaacatactggtgacaaggtggcaatcaagaaaatacacaatatctttgagcacttatctgatgctgcccggatcctacgtgagatcaaactgcttcggctattacgccatcctgatatagttgagatcaagcatataatgctgcctccatcaaggagggacttcaaagatatctatgttgtatttgagctgatggatacagacctccaccaagtcatcaaggcaaatgatgatttaacccgagagcatcatcaattctttctctatcagatgctccgtgcactgaaatacattcataccgctaatgtttatcatcgtgatttgaagccaaagaatatattggctaatgctaactgtaaacttaaaatatgtgattttggattggcaagagtggcattcaatgacactcctacaacagtattctggacggattatgttgctacaagatggtatagggcccctgaactgtgtgggtctttcttttccaagtattcgccagctattgacatatggagtatcggttgcatttttgcggagatcttaactgggaagcctttatttcctggaaaaaatgtggtccaccagttagatttgatgactgatctcttgggtactccatcacttgatacagtttccaggattcggaatgagaaggcaaggaggtacttgagtagcatgaggaaaaaacagccagtaccatttactgaaaagtttcctaaagcagatcctgctgcactcaaacttttgcagaggcttttggcatttgatcccaaggataggccaactgctgaagaggcattggctgatccgtattttaaaggcctcgcaaaagtagagagagaaccatcatgccagccaataacaaaaatggagttcgagtttgagcgaaaaaaggcgaccaaagaggatgtcaaggaacttatattcagggagatattggagtatcatcctcaacttctcaaggattacatgaatgggactgagaaaacaaactttctatatcctagtgctgttgaccatttcaggaggcaatttgcaaacttggaggaaaatggaggaaagagtggggcacacgccgcttcatcagacaggaagcatgtttcgctcccaaggacaaccacagttcattctaatccaatccctccaaatggaacctcccaggttcctcaaaagattcccacaggtagaccaggaagagtggttggtccagtaataccatttgagaacgcagctgcagttgatccatacagccaacgtagggtctcaaggaatccagtacttcctccaaccacgtcgaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaggtaccgaagaactgccataccggctctgagccaaagatagaaaacatggaatacggatctcggatcgaggacgtgtccgtcagattgaaaacagatactgggcagcagtcatggttctgtccattggacctagcttttcgggaagcaatgccatcgccccgcggaaacggtaaaataaaaggagaaaaaaaaatgcagtactgtcagttgattgctgcttataaagaagcaaagggggcagagacgacgatttttacaggtaaaattatgtactttgcaaggagggaaacatgtgggaataagtagtgagcctacgtttagctctgtatataaagtgacttgattttatatgtactattacggctggtgaaacacgcttctttaattcaaagctatggagttttggcctaaataccataggcagctcagattgat

SEQ ID NO: 9511 - DNA, 825 bp, Zea mays
gcccggccctgcgagcgagaccaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctccgtctcctctagaagccgcagcaacgatcggtctatagtttgaactcgcctttgaataacttgtcgttgggcaaggtctagttcggtgttgtgtatggaacggtcgtcactgagtcatgcacgatttggtatccgtgttgtttatgttcaccggtttgaggaactctctgatccgccgtgacacaaagttgatcctgagagaacgaccgagtatttttttttcc

SEQ ID NO: 9512 - DNA, 654 bp, Zea mays
tagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgctagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtaaagcacgtagctaattagacggtgctgccttgctgttcaataatatcgtctgtcgtcgcgtacttcataacctgcgcggcgtgttagtagttgtttggtggtgtttggcgactggcactacagagaagtgtcagatcgagtgatgtacttgctaccaacaataaaggtatacacggtttgtgtgttcacttg

SEQ ID NO: 9513 - DNA, 1870 bp, Zea mays
tctctctctctgtcgccaggagggcgccgccgccaccaacgcaacgcgcgccgccgcagatctccgccaccgacgcgccggccatggagtacgagcgcattgagaagccgttccccgtccagggcggcgggttctcgcccaagcggctgcgcgcgatgctgctgggggtggacaagcgccgcaaggggcaggacggcgccgccgaggaggacgaggacggcggcggcggcggcgactacggcgccctgcccaaggcccacgccagatccggcgccggcgacggtggtggcgccacgtgcgaagaatacaaggacgtggacgtggtgagcaccacctcagagttctcgtcctcgctggagacagcgggtgggcaccggccccgggacgcccaccccgtcgccacgggttctaggaccagggtgccgcccgaggaggactcgtgcgactcggagagcgtggcatccaacttcgagttccacaaggagcggcgggcagcggcggcggcgtcggtcgtccctccattctcaaagcccgccccgtcaaagtgggacgacgcacagaagtggatcgccagcccgacggcgaactgccctggcaggggtggcgcggctcctgcgccgaagaagacagagaaacctggctccggcatcgggaggctgccgctgccggcgaccaaggtcgtggtagaggccaccgaggagatagataccaagaggatggatccgagccaggagaagcgtgagattgggtggcagaaagcggcgaggtgggcgccgcccgacccctgtccggaggtggagccctgcccaacaaagaccacactactcgctgtagaaactacagtggctgctgcttcagcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagcccaaactgctcccagccaacgactccacggaggacgctcggtggccccagcgcagtcggctccttcatcagccacggaggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcctcgctctcgctgaaaccggtgcccatggaccagtcgacgcagaacataaccgcgatccgtgcggctgcgtgggaggaggcggagaaggccaagtatttagcgagattcaagcgagaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccacggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgttgtaactatatatatatatatatacacacgtatgtaaggtgtgagatccatgcgtcctgtgctgtggtggttactgtgtaagtgtcacagatgtaccgaattcaaggccgagcttggattcctagtgcacatatgtgataaacttcacaccaagagacctccatgctagttgtgactg

SEQ ID NO: 9514 - DNA, 1895 bp, Zea mays
ttgccccacggaacaaggaaaagggtatatgctcccgcagccctcgtggaaaccaagggcggaccttcccctcctccaagcaaatccgaggcccacccacgggccgctcgaacatctgtcaccgccaagtggccccaccccacccctcccctccgctgccccttcttctacaaataccccggccggccgcggccgttcccgaatcgagcggtgactggcgaggcaaaagcattgcgaccacagacagcgcgcgcttcaaggcctttttttttttgagataacaaggaggagatggcggtcacgatcacgtgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtctttgctcgagagctactcaggtgattttgtcgtgggagcaccaaaagcagaaaagaactgtttttttcttctctctctctagattctgacgagtggtggtctgcactcgtcgtaatgtcgtttgcctaaactgattttgatggaacaggaaatcttgctggtct

SEQ ID NO: 9515 - DNA, 1971 bp, Zea mays
cgcccgccctccagcccaggtccgcgccgccgccgcgccgaccacaatcccagcgcccgctgcccagacccagcgccgcctgcggttgtgagcgcgaacaggagagagcgggtcttcggggcgagcgccacgcgcagacggcggttgaggagcctgagaaaaccctggtcttccttcaagatcctggtggatcgcgcccagctccgcgaaatttccttgatgtctatgtaggttcgtcctaaagattcgattttgttggctcttttgatccgacgcagatccgtacggttctcgcctgattctgcaattcaggcgccaggaggcttgctggctgtttttggattggtgtcttctcccatggggtcttgcaggtgtaggagggtgaattctgtctgattaatcagcggagggcaagcggctactgtggctgcgcgaacatggcgggcgagcaggctccggagggcagcgggaccagtaggcgcatggatctaaacctgtatctcggactccctccattgccgaggcctccagtctggctaggcacagcgatgattgccccgacgttgatgcccaattcgactgcgccggaagccccaagaacaggcgagcctgacgaatcgctcgccccggcggcggcagcctattcgccttcgaatgcgctttccaccccggaggagcaaccaatgcttgatcccatagtttattcctggctcgatggcaacagtaccgatggtgaagagcacactgatgcttctgagccagggccagtcgatggtgtcaacgtccctaggtcgcagcttttggtagctgccactgggttggaaggggatgatattcctgtagtaaggtttctgcgccctagtcaggtggctgctggtggaatggagatggtgagcacaagtatacttcggcgatccaatcaaggggctgctgcaattgagtccgggacccctgagctccgctttcagagggtgatacagattagccagcagcacagcattgtgaggccagcatcagcgaaccacagtcaaggggcagctagtacagatgcggataggcttgtctgggcaatccagcgcacacataactcttatgaagcagcaaggcggcaaaagctagatggcgacaacaaggtgtgtggaaacagtgcagctaagaaggatgggtcctgtgattgcaactccagctttgagtgtaatatctgtcttgacccagctaaagagcctgtggttacaccctgcggtcacctcttctgttggccatgcttgtaccagtggcttcatgcacattcactccactctgagtgccctgtatgcaagggtgaggtgctagaagtgaatgtcactccgatatatggaagaggcggtgaagaaggggattccaccaaccctgacttgccacccaggccacgagcaaacagaagggagagcctgagtcaacagctgcaaatggcagacacaagaggaattgcaacagtggtgaggcagttgatacaaaaccaaggtatagttagaggcctcccaagctcaacagggatcgaaatgactgtggttactacaggtcggcaaagggctagggcccggagaccacaaaggcaggataataacgcatcaccttccatacatgttgcagcacagaatatgggcaatgttgcctctgagagcagcaatcaaatccagctgccacattctaatggcgacaatgctgcacagatggttcttgcatctcctcagcagtcatcgtctgtcgaacagctgtcaacttctagcaccacagctcttatagtgggtgagcctagatcaactaggcggttaaggcctttggagtccccaaccataagaagaacaaggaggaggccgctgtaggtaccaaagtggtgtcactcccttcaatgaaacctacagaccatgccccattgttagttattaccatgattagctccaataacatctcaaggttaataatgtaggc

SEQ ID NO: 9516 - DNA, 1277 bp, Zea mays
atcccaaatggcgactgcagcttcgcccgccgctgcctttccccacatcctctccctctcctcctaatcccctcccaatcccccccccccctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcactgaagcttgcagactttggtttagccagggcatttggaattcctgtccgtacatttactcatgaggtagtgacattatggtacagagctccagaaattcttcttggagcgagacagtattccacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttccccaggtggcaatctcaggacctggcaataatagtcccaaatcttgaacctgctggcttggaccttctctctaagatgcttcggtatgagccaagcaaaagaatcacagctaggcaagcacttgagcacgagtacttcaaggaccttgagatggtacagtgacctgctaaatgtgcttcgcgttgctttggcatttgtaattgtctgagctgagtcgctcattcctttttatgggcgtctgtactctctcattctctctgcatttttgtcgttcagctggatattttgaatctggtgtgttttgagatgtattaaggaatatcaaatagattaccgccttggtctctatttactgaaagtaaatatcctccatgtttatttcccccgaagcag

SEQ ID NO: 9517 - DNA, 1596 bp, Zea mays
ctcgcgattactactgtaatccccaccacaccacctcccggatctcagggtgggtggagtgcttcttggcgacctttctttgcatgtcaacgcagacaaaaagaacagcgccgccgcctccacgaccacgaccacgccggtcgccgagcctccgtctcctcccgagagatctcgcagccagctagccgccgtacgtggccacatggaggcgccgcggccaaacaacggcaggaagcgcaagcccacgcctcccgccggcctgggggccctccacgacgacttgctcgagcgggtcctcgcgcgcctcccgccggccacctacttccgcctgcgcgccgtctgcagccgctggcgcgccgccgcggcgtccccgaccttcctccacgcctgcgctcgcgtcccctcccgggacccatggttcctcatgctctccgactccgactccgggccccgcccgcccgtcgccttcgacgccgccggccgcagctggaaccgctgccacgccgcgccgggggctgccgtgcccgtggccgcgtcggccggcctcgtcctctaccgcgcgccggccacgggcgcgctcaccgtcgccaacccgctgacaggcgcgtcccgcgcgctcccctcgccgccgcagcaggccgcgcgccagctgcaggccatcgccatgtacggcgccggcggtccctaccgcgtggccctcttcgcgggcgacctccccgacgacctctccatggcggtctacgactcctccagcaactcgtgggaggggcccctgccgctcgcccgcaagcccggggacgactcctgccccgacgcgccggcgcccgacgacacggtctacttcctcagcaagtccggggacgtcgtggccaccaacatgcagcgcagcgcgtctaagcagtactcctcctcagtggtcgtgcgccgcgacggcgacggcgacgccgcctttgcctacttcctcagctactcgggcacagtcgtcgcctgcgacacggcgcgccgcaccttcgcggagctgccccgcatcctccccgtctacttcgagtactccatcgacgtcgtcgcgtgcggcgcagcggcctacgccgtcgtgctttcggaatacctcggcacggccagcctgcgcgtctgggagttcgccgggggcgcgtggcggcaggtggccgccatgccgcccgccatgtcgcacggattccacggcacgcggcccgatatcaactgcgtcggccacggcgaccgcctcatggtttgcgtcacctccgccgaggccaacgcctgcttcatgtgcgacgtggccagcaaccagtgggaggagctgcccaagtacgtcaatgccgacggcgaggccagcgagttcctggccgccttctccttcgagcccagagtggaggtcaccgtataagcgcttatggttatagtgttactacaattaattgctttcttcattaaggcgccatagttttggttcggctcctactccgtgtgattgatttcttcgtgtgtgtgtgcatgtacttacggtaccgaattgtaatgtcatttttcattgacattatttgtcttcaataaaattgcagatttcgtgtgcagtcc

SEQ ID NO: 9518 - DNA, 3873 bp, Zea mays
ctaagcaaagccccctcgcttttggcgtatgcccccgctggcgcgcccatgattcccgccgattcctccgcccgttcagtccagcaacccttgctgctgcagtgctgcggctagttcggtggcggggaaggaggaggaggcgagatcttggagtggggcgaagcggagatgtcgttgccgtcgaacaaccggaggacgtgctcccggagcagctctgcgcggtccaagcacagcgcgcgggtggtggcacagacgcccgtggacgcgcagctgcacgccgagttcgagggctcccagcgccacttcgactactcctcgtcggtgggcgccgccaaccgcccgtcggcaagcaccagcaccgtctccacctacctccagaacatgcagcggggccgctacatccagcccttcggctgcctgctcgccgtccacccagacaccttcgcgctgctcgcctacagcgagaacgcgcccgagatgctcgacctcacgccacacgccgtccccaccatcgaccagcgggatgcgctcggcatcggcgtcgatgtgcgcacgctcttccgctcgcagagctccatcgcgcttcacaaggccgccgccttcggggaggtcaacctactcaaccccatcctcgtgcacgccaggacgtcggggaagcccttctacgccatattgcaccggatcgacgtcggccttgtcatcgaccttgagccggtcaacccagccgacgtgccagtcaccgccgcgggcgcgctcaagtcgtacaagctcgctgccaaggccatctccaggctgcagtcgctgcccagcgggaacctgtcgttgctgtgcgatgtgcttgtccgtgaggtgagcgagctcacgggctatgaccgggtcatggcctacaagttccatgaggatgagcatggcgaggtcatttccgaatgcaggaggtccgatctggagccgtatcttggactgcactacccagccaccgacatcccgcaggcgtccaggttcctgtttatgaagaacaaagtgcggatgatatgtgattgctgtgccactccagtgaaggtcattcaggatgatagcctagcacaacctctcagcctctgtggttccacactcagggcttcccatggttgccatgcacagtacatggcaaacatgggttctgttgcatcacttgcgatgtcagtcactataaacgaggatgaggaggaagatggggataccgggagtgaccaacaaccgaaaggcaggaagctgtgggggcttgtcgtctgccatcatacaagcccgaggttcgtccctttcccactaaggtatgcttgcgagtttctcttgcaagtatttggcatacagctcaacaaggaggtggaattggctgctcaggcaaaggagaggcacatcctcagaacgcaaacccttctttgtgatatgctcctgcgggatgctcctgttgggatatttactcggtcacctaatgtgatggatctagtaaagtgcgatggagctgcattgtattaccagaaccagcttttggtgcttggatcaacaccctctgagtcagagataaagagcattgcaacatggctgcaggataatcatgatggttcaactgggctgagtactgacagcttagtggaagcgggttatcctggtgctgttgcacttcgtgaagttgtgtgtggcatggcggccataaagatctcttccaaagattttatcttctggttccgatcgcacacaacaaaggagatcaagtggggtggggctaagcatgaaccggttgatgcagatgacgatggcaggaggatgcatccacgatcttcattcaaggccttcttggaggtggttaaatggagaagtgttccctgggaagatgttgaaatggatgctatccattctttgcagttaatattacgtggctccctgccagatgaagatgccaacagaaacaatgtaaggtccattgtaaaagctccatctgatgatatgaagaagatacaggggctacttgaactgagaacagttacaaatgagatggtccgcttaattgagacagcaactgcccctgtcttggctgtcgacattgccggtaacataaatggatggaacaataaagctgcagaactaacaggtttacctgtaatggaagccatagggaggcccctgatagatcttgttgttactgattctatagaagtggttaagcagattttggactcagctttacaaggaattgaagagcaaaatatggaaatcaagcttaaaacattccatgaacatgaatgcaatggtccagtaatcttgaaggttaactcctgctgtagtcgggacctttcagagaaagtcattggagtttgctttgtagcacaagatttgaccaggcagaagatgattatggataagtatactaggatacaaggagactatgttgccatagtaaagaaccccagtgagctcatccctcccatatttatgatcaatgatcttggttcctgcttagagtggaataaagctatgcagaagattaccggtataaagagggaagatgcgataaacaaattgttaattggggaggtcttcacgcttcatgattatggctgtagggtgaaagatcatgcaactctaacgaaacttagcatactgatgaatgcagtgatttctggtcaggatcctgagaagctcttttttggtttcttcgacacagatgggaagtatattgaatccttgctgacagtgaacaagaggacagatgctgagggtaagatcactggtgctctttgctttctgcatgtggccagtccagagcttcagcatgctctccaggtgcagaaaatgtcggaacaagctgcgacaaacagctttaaggaattaacttacattcgtcaagaattaaggaacccactcaatggtatgcaatttacttgtaacttattgaagccttctgaattgacagaggaacagcggcaacttctttcatctaatgttctctgtcaggaccagctgaaaaagattttacatgacactgatcttgaaagcattgaacagtgctatatggagatgaacacagtagagttcaaccttgagcaagctctgaatacggttctgatgcaaggcattcctttgggcaaggaaaaacggatttcaattgaacgtaattggcctgtggaagtatcatgcatgtacctttatggggacaatttaaggcttcagcagatcctagcagactatctagcatgcgcccttcaattcacacaaactgctgaaggacctatcgtgctccaggtcatgtctaagaaggaaaacattggatctggcatgcagattgctcatttggagttcaggattgtccatccagctccaggcgttccagaggccctgatacaggagatgttccagcacaacccaggggtgtccagggagggcctcggcctgtacataagccagaagctggtgaaaacgatgagcggcacggtacagtaccttcgagaagccaacacctcgtcgttcatcatcctgatggagttcccagtcgcccagctcagcagcaagcggtccaagccttcgacgagtaaattctgaccctcatgctcctggaactgcagcgagtgttcggccgtgtcgaagtctcggttgtagctagccaagtggctgctactgaaaaacatcggttggtcggttctggtatctagcacggcctgtgtagtgcggatagatttggttgtttggctttggagagagataagctagctggctaggtgtaacgtaacgtcgaccgataactgtatgtgaatgatgatgagctgtgaggacgaataaaggcttcacttgtgttctccattgctcttcttagagtatgatggccaacagctgtacagg

SEQ ID NO: 9519 - DNA, 2595 bp, Zea mays
ctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcct

SEQ ID NO: 9520 - DNA, 2345 bp, Zea mays
gtcgatattattgggagggtgggtctcccgtcccgtttcgatgaggccggaggagagagatgctgccgtggggagagtcagggaccagttccccgtcggcatgagggtcctcgccgtggacgacgaccccgtgtgcctcaaggtgcttgagaacctcctgcgccgctgccagtatcatgtgacaacgacgaatcaggctgttgtcgccttgagtatgctgaggcaaaacagggacctgtttgatcttgttattagtgatgttcacatgccagacatggatggctttaagcttctagagcttgtggggcttgaaatggacctccctgtcattatgttatcggtgaatggagagacaaaaactgtaatgaaggggataactcatggtgcctgtgactatctcttaaaaccggttcggttggaagagcttaggaatatctggcagcatgttgttaggaggaaattcagtaactgtgatcgtgctaacattgatggctatgaggagtgcaataggccatcaaatgcagattttgatcttgcacacagccaaattacagctggaccacctgaccaaagtgggaggcccagcaaaaagaggaaggaatatcatagtgaagaggaagatgaaggagaagagagtaatggccaagataacgatgatccttcagctccaaagaaaccaagggttgtttggtcagttgaactgcaccgaaaatttgttgctgccgtcaatcagctaggaattgacaaagctgtgccaaaaaggatacttgagctcatgaatgttgagagactcaccagggaaaatgttgcaagtcacctgcagaagtatagactctaccttaaacggctaagtgctgtggcatcacaacaggctagcattgttgctgctttgggaggcaacgacccctttatgcggatgagtgcatttgaaggactccatggttatcaatcttttgtctcttcagcagctctgccatctttcagtccacagggactgttaaatagaaataatccagcatcatttgcgattcaaggggtgtctgcttccaggccaattcagattgcaaccggcaataccacaatgagtcattccattggcgatcaaaataataaatatcaccttagcttaccaggcactagttgcctacaaggaaatctagcacaaggtttgccaactccagttgggcaggtccagctgccacagaagtggatacacgaagaaactggcgatctatctactatcctttctgcgagtggccgggctaataatggtgttcctggcacactccaaagtgtcacgaacagtcacttgctgcagcaaggctttgttgaacgtagacaagaaaaagttgttatccagccatcttcatctgcaagttcagatcgtcctgaaggcactgttggagtttcctccagtctgatggattcctgtgcaacccagcagagggttgttccattgtcagccttctctagcagtgcatctccaatgaatggctcgttttgcagcaacggtgtagctgagttgggtgctacatcctctggaggtacaagtattttcccctccaatgacctgaggatagaaagagacagcaaagtgggagctagctcttttggtagtgtgatacttctgtctccagacactgtgccaaaccaaaaatacttgaacttcggcggtgaaagcgatttgagatcgaacatggatggagggaacgcaggcaatctgttgaatcccaagctactatggagttgtttgccggcctctcagccgcctaatcttatcggaagtcatcatcccatgagccaaagactgaaccttggcggctcaatggtcagacagacaacagcaagtgcttcggcagctgccccacagacaaggatcgacatgtttatctccggagacgctccgaagagcgcgtcggatttgagcttccctaaggtccacagcgagcttagctctagcagctgcagctttgacggcctcctcaactccataatcaaagtggagaaggacgatgcttccttcagcgatgacctgggatgcgacttgtactccctgggtgcctgtatatgatcgctaccttccacgtatctgcatctgtgttaatctcccattgtatgctgtgcagctagtgttaatcttaggtagaattgtagctgtgcgcctatctttgcttgctcacagccaagaaaaaaaaaattgatgtctgcacgtgatgtgctagcagtaagatatctggatttgtggaagtcaatgcccatttgctaaatcgagctggagacactgttggcacgagttgattctaaaagcggccttgatgatctaggcccaatttgaatgtcgacac

SEQ ID NO: 9521 - DNA, 1694 bp, Zea mays
gatcctctagagcggccgcggcgcacgggcacgttctggacggccagcgcgcacatcatcacggccgtcatcggctcgggagtcctgtccctggcctgggccatcgcgcagctgggctgggtggccggccccgccgccatgctgctcttcgccttcgtcacctactacaccgccacgctgctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcacagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtcgcgcgggagctccgcgtggggcccctcgccctcagcgtgttccgcctcacgtggcggtcggcgttcgtgtgcgccaccaccgtggtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggactggcctgggtttggacgtatgtgcatgcagcattcattgcgttgcgttcaactgtggtcaacaagggagggagacggatgcagatgcagtgtgagatgtttgcatggaggcccctatagaaacaagtgaaatgtttaggcgcccttgtgcacataatggtcgcattccttgcaagaataccaggggtggggccagaatggcatgagctgggtgtttgttgtgatgacgagtctactgtaggtgtatgaagcagcaacaaaaaaacatgttccaaaaaaaaaaaaaaaaaaaaaaaaaagggcggccg

SEQ ID NO: 9522 - DNA, 2039 bp, Zea mays
agaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgtttttttt

SEQ ID NO: 9523 - DNA, 1277 bp, Zea mays
ctcgcccaatgcgtagttgtatctgcatctccaacaccaccagcagaggttccagttagtttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggccccgaggccggcgtgtccgagaagacgtccggcgcgtctgacgacggcggcaggctccgtggagccggcgggaacgccttcccgtggagcaatgcgatgctgcagtggcagcgcacgggattccacttccagccgcagaagaactggatgaacgaccccaatggccccgtgtactacaagggctggtaccacctcttctaccagtacaaccctgacggcgccatctggggcaacaagatcgcgtggggccacgccgtgtcccgcgacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccaaggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcccgggcctgctccaccgcgtcgacggcaccggcatgtgggagtgcatcgacttctaccccgtcgccacacgaggcagggcgtcggccaacggcgtcgacatgtccgacgccatcgccagcaacggcgccgtcgccggggacgtcctgcacgtcatgaaggccagcatggacgacgaccgccacgactactacgcgctggggaggtacgac

SEQ ID NO: 9524 - DNA, 736 bp, Zea mays
cttggaacatttgtagaggagaagggataagatcaacgagaagctgaaagcattacaggagcttcttccaaactgcaacaagaccgacaaagtttcgatgctagacgaagcaatcgactacctaaaatcacttcagctacagcttcagatgctggtcatggggaagggaatgtcaccagtggttcctcttgagctgcagcaatacatgcattacatcacggctgaccctgcccagttgcctccgttgcgcccctccggccagcagccccgacaatttcagataactcaagccaatcctcagcgacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctcctaatgacaaaatttgacacggcaggcgtgcagccttgtactggcaagcgattattcagtttgggacctgcagcatggttcacctgagagaattccatgaatgtgtagtactagttaactagctagctagttgtgttattaaataaaacgttgtgattgtgatgctgctcattttgctatctgaatcttaccgtccaattctcctccatgttcatgcaaaggctgacaggtggcgtctg

SEQ ID NO: 9525 - DNA, 1350 bp, Zea mays
gcgacacgggtgttcagactccacaacaatttcgtttgcctcgcacaaaggaagtaattgtaaatgggatcagtgtacgggtcaaatactgtgatacttgcatgctgtaccgaccacctcgatgctcacactgttccatttgcaataactgtgtggaacggtttgatcatcactgtccatgggtcggccagtgcataggactgcgtaattatcggttcttctatatgtttgtattctcgacgacattgctctgcctctatgtatttgccttctgttgggtgtatgtgatcaagattagagctgctgagcaatcgtcagtttggaaggccttgctgaagacaccagcatcagttgctctgattatctactgttttctctgtgtatggtttgtgggtggtttatctgtcttccatttatacctgatgagcactaaccagacaacatatgagaatttcagatatcgctatgatcggcgcgataacccatataacaaaggtgttctgaacaattttctagagatattctgcactgctatccccccttcgaagaacaatttccgggcaagggtgacagcggggcaagggctgcagcaaacgcgctcacagtccaggggtttcatgagccccagcatgggcaagcccattggagatcttgaaatggacaggaagccagtagcaccttgggacgagccaaggacggcggctgatatcagggacttggaagcagggcttggggtcatgttcgatgagaaagagggcagggtagctcatgcatccccagatctgagcagagaccttccagcagagttcgtggaaggccgatctggtatgcactcgaggcagtcaagctgggttcagagaggagacgcaatcgaagcgtcggcggtgcaaatggctaatgcgcgcaccacggaagctagcaacaatgttgcctggagcggtacacattaacccaaaaaatgataaaaagaaaaggaggaactatggtgtgttggcgatgtctccaagtgaacccccgtgtgtttgttgccacgtgtgctgctccgggtaaggccctggatcattctgtaatgtataaatcctaagcacaagcttgctgctattgtttcatccctggtagcgtaccaggtccctgcggctgctgctgctgtcttgtgtgtgtttgtttgggtgacaaattgatgaagtggccgacgagcttaagctcccgccaggttcggatgatgtatacaaaattgttgtcaggttccaacggatgctgtgcttggtttgccacaccagcgctgcgtgctttgggtactcgcaagtggcatctgggcaccccgctcccatgcaaacttgttcttggtgt

SEQ ID NO: 9526 - DNA, 1583 bp, Zea mays
gctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttcgagtt

SEQ ID NO: 9527 - DNA, 1261 bp, Zea mays
gggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaatcgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtccgtcgtatatataatcccttgcgtgtagtaagcgatgaactgaatgcatccagaatatcatgtcatgataaacttgaatatagtttcatggttgttatttcagactgaaaataaaatcagtcttctgttccggtt

SEQ ID NO: 9528 - DNA, 1651 bp, Zea mays
cacattcctccctcagtccctcttccccccgtttcatcccttcacacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccagccacgggcgtgcacgagctgctcgagtgccccgtctgcaccaattccatgtacccgcctatccaccagtgccaaaatggtcatactctatgttccacctgcaaaactcgggtgcacaaccgctgcccaacttgtcgacaagagctaggtgacatcaggtgtctggcattagagaaggtggctgaatcacttgagctcccctgcaaatactactctcttggatgttcagaagtcttcccatactacagcaaactcaagcatgaatcacagtgtaattttaggccatacaactgcccttatgctggttctgaatgctcagttgttggggatatttcttttcttgtggcacatctgcgagatgatcataaagtggacatgcactctggatgtacatttaatcaccgctatgtcaagtccaatccaagagaggttgaaaatgcaacttggatgctaactgtttttcattgttttgggcagtacttttgcttgcactttgaggcatttcagcttggaatggcaccagtatacatggctttcctccggtttatgggcgatgaaaatgatgctaggaactacagctatagccttgaggttggtgcaaatggcaggaagatgatatgggagggaactccccgcagcatccgggacagccaccggaaggttagggacagccatgatggtctaataattcagcgcaacatggctctcttcttctcaggtggagaaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgccctaaattagtcagggcgtatttactgttggcaggataatgaaaatactggcttactccttttgtgggctgtgactaagctcccatgaatctcacgataagcatttttctcgatccaatggtgtatactgtatcgttttgggctgaaggctgcagctttttttgctgttatgtttgtctcggtgtatttgtgtgtctgcaaataaagtattgaacagtaactgggtaccttgcataaggtttggttggc

SEQ ID NO: 9529 - DNA, 1689 bp, Zea mays
gcggcttccacgcctttccttgctgctgatgctactccatttcctcccccggtacagcctgacccaacaaacgcacccccaggttaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagcctttttcggcagggcatctgctagagccggccggttgaagcaggggagcgagaggaggagggcagccgaacaggagcgtcgcagtggtggttaagcagcagcaacgacgacgacgacgacgacgctgagaggtttccccgttcccgacggcacgtccaccgaggcggcgccatcacgatgggtcctctggcgccgctgaggtgtaacccgccgccgctgttctccaagtcgccggggtccctgctgctgctgtccaagtcgctcaccctctactgctgaaccgagccccctcttcgatcggttccatgggcgccgtggcctcgtcggcgggtggggcccggggaggcgatggcacggtgctgggcgacctgccggagaactgcgtcgcggaggtgctgctcaggctggacccgctggagatctgtcggttggcgcggctcagccgcacgttccgcggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccaagaaggaactgtacgcgcggctttgccgtcggaaccgtttcgacggcggcaaaaaggagttctggctggacaagggcggtggaggtctatgtatgtcaatttcttcaagggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaaccgcagcacctcgcgcagaaaaaagcgccctggacttacgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcct

SEQ ID NO: 9530 - DNA, 2155 bp, Zea mays
cctagctacctggccgtcccctctccgattacggtcggaagcctcagctgaaggatctggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggacacccatgtcgtgccgcagcgccgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacgtctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgtaacaacagctacgccattgatctgatgatcccagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcagtcgctatctcaggcagtgaggtggaggaggagcatctaggcgtcgtcccaggcgaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccgggttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggctggtcactggaactatctataggaagcctatggtgatagatactgagttgtagtagaacacatatagcctaaatgcctaatgctgtgatggcagtcactaccagcctagcctagaacaggttgatgatgtgtagtagtaagtttgggtatatgtttcagttaatc

SEQ ID NO: 9531 - DNA, 821 bp, Zea mays
gcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 9532 - DNA, 1278 bp, Zea mays
caccaatacactacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggggcggggatgggagcggaggcggccggaggaggcacggggcggcggtcctccttctgcctgtacgcggccggccacggcggcgccggcaattctggcaagcggagcggcggcgtggtgcacgggcacgggtggacgctggacagcaatgcccgggaggccaaggagcggctggaccagaagctcaggaccaagagggaggccgccatcaagaggcaccacagcacggggagcataaagctgggcgtgccgcaccggagcgccggcgcggacgagcgcggcgagagctccgcgccggcgatggccggcgtgcagcgcgaggtgtactcgaagaagggcgtgatgcggcggctgatgcggtggagccggccgcggtgggccgcggcggagcaggcggagtgcgcggtgtgcctggacgagttccgcgcgggcgacgtgctggcgcacctgcgctgcggccaccgcttccactgggcctgcgcgctgccctggctcgagggcacctcgcggtgccccttctgccgcgccgccgtggacgccggcgccgccgccgccgccgacggcgcctagaagcggccgaggctctggtcttgctggggcttgccctgggctgggacggcgcggggcgccttgtcgctgtcggcccacgccagccacgccacccccatggcgttgccacgctaggcagtggctagtgggggtggtcatggtgagtggtgaccggcctgcttgtgcatgtggcgcggagcggaggaggacagcgagacgcgcacgacgaacccgtgagtgccttggcagtttttgcacgctttgcgcgcgcaaaggcacggttggtgcacatttgttggttgggccgtttggcccccctttgccgtgtcctcctcccatcatcgcgagcaagtgatgaacggttttgtttt

SEQ ID NO: 9533 - DNA, 2895 bp, Zea mays
ctcggtcgactactggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgtccgacacgcccaagggcctggaggacctgaggaagaaggacctgcaggcgcttcggggcgacggccacggcgagcgcaaggcgtccgagcgcgtctacgactacgacgtgtacaacgacctgggcgacccggacaagaaccccgcccaccagcggcccgtgctgggcggcagcaagcggtacccgtacccgcgccgctgccgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagtccgccatcaccaaggagatcctggagaagcacatgagcggcggcgccgccatgaccgtggagcaggcgctcgcggcgaagcgtctgttcatcctggactaccacgacgtgttcctgccctacgtgcacagggtgcgcgagctgccggacacgacgctctacggctcccgcaccgtcttcttcctcacggacctgggcacgctgatgccgctggccatcgagctggtgcggcccaaatcgccgacgcagccgcagtggaagcgggtgttcacgcacgggcccgacgccaccgacgcctggctgtggaagcttgccaaggcgcacgtggtgacccacgacacggggtaccaccagctggtgagccactggctgcgcatgcactgctgcgtggagccctacatcattgccgcgaaccggcagctcagccggctgcacccggtgtaccgcctcctgcacccgcacttccgctacaccatggagatcaacgcgctggccagggaggcgctcatcaacgccgacggcatcatcgaggagtccttctggccgggcaggtacgccgtcgagctcagctcagcggcgtacggcgccacgtggcagttcgacacggaggcgctgcccaacgacctcgtcaagcgtgggctcgccgtgcgccgggacgacggcgagctggagctcaccatcaaggactacccctacgcgcacgacgggctcatggtctggaacaccataaggcagtgggcggccgactacgtcaacgtctactacaagtccgacgaggccgtcgccgccgaccccgagctgaaggcgttctgggacgaggtgcgcaacgtgggccacggcgacaagaaggacgagccgtggtggcccgtgctcgacacccgcgacagcctcgcggagacgctcaccaccatcatgtgggtcacctccggccaccactcggcggtcaacttcgggcagtaccacttcggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggagcccatggtgaaggcggcgttcgagaagttcggcggcaggatgaaggagatcgagggattcatcgacgagtgcaacaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaat

SEQ ID NO: 9534 - DNA, 3679 bp, Zea mays
tttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccaggtatacgtattcgatccccttgttcctgccggccggttgctacgatcgcccgctcggggtttgaagcgctgggtgtgcttcgacgcatgatttttggatcatttttcatgtgtcaatccgctgccggccggtttctatgttcgcccgcttggtgtttgtagtgctgggtgtcgacgcatgattttggaatcacttttcatgtgtcaatctgctgcgttcatcgaacttgtatggggattgagctgtgggaggtgtttgtagaacgtagacacatgcatgtatggttgttattacgtgttagttctatgtggattaattatagttatttccatggacactgctcggccggtcaacgatcgcttcagatgattcaaccgtggaatcatcgcttgctggttaattcgttcgtacgtacacagtggcatacgcaaattgagcgggatactgtagttttgcaaactgagaatgttatgagtagtggtgctggtgaatgtcaattagcccatgcaaattatgtcccaagctttgaggtgtgactgactaatggctagtatatagaaagtggtcaggattattatttggttcataaatactgtgaagaggtgaggatcagtcgctggaaggattctgattgccaaaatatatttttttcatcatgcgatcaaactcttcagtatcaagtaggtgtattatttcagcataatttattgcaaaggaaacacttcttttgtcttttgcatgcatgatgaaggatatgcttatcagtatctctatggtggtgtttggttcattgcatggagtggttaacgtaacctgaacggatcccacgactattggttacagtgcaacagagatacgtttggttagttaacgtcgaaaagatatggctccgtatccatttgtgaatcgttacggactgacccaaccaaacagaaaagaaagggaatagatggatcacagataaaaatgtcataccaaacagcctctatactattttctgcttcgatgttccttgtatatgtgcatcttgtcgatttttcagatagcctgtgataaatgtgcacaaatttctatacaaacagctgttgtggtcatgctgtagaagattcatatggagaagtgttattaattatctgaatattttcagaaattccagaagaacaattctgctcttgtgtggtgtctctgattcatgcatgtgtcatatattaagagattgtccctgttccacattttagtattatataaacggtatacaaggtgatcataatatttaaacattagtttgattttttggcacatatttcattacagtttcaaatatggttccttaaacaacacggctatcttagaaaatagatgcttgattatagcaaaaattgaccttatgctgctataagttagattctaggaggttaaattggcatgagtacatattctgaccatgcaacatattcatatataaccgatcgattcagggaaaatgtcactgagttaacttaccctccccacactggattatctgtaactctctagtgctggagacaaaatatgtatgttaaaaaataataagcacgttttagcttttgcacacgagtgatatgtgttggtgatatgatccgaagttgatagagattgtggcttgagtcaccgcaaaatttgatgacattttctttagctgaacccatgccggtaatgaattttattttaaaaaataatatgatatggcttaatgtagatccatttttatatgttgtggattatagaaaaccatgctaattacaactacgagtttgaatttgaaatatcaatagattcctacaaaaatgtatatcactatacttttgctaatttactaaagatgttacaaactttactgttcaaacccgacaaaaaaggtagatgccaaatctgtctaaaagattatattagatcgatccacagattatagtatcaaagtgatggaaaacattgtttgcacaaacaactgagtagctcgctacattttagagctatttttacatcattatttactcttgacttgttttattgttctaaaataccctttctgagttcatgtatgaactatatatgaagcaccatctgttcattaagtaatgacccacttatgtgtgcatgtgatgacagacgttgttccataaccatgcttgcatctagctatgcatgtgattcaaggttagctgtccaatgtcttttgcaattctggaatcgggagaatatacttgtatatatatatcttacatttatcaaatagggagaaattaaatcttgatatcttgaacgttgttcatcgtgaattttgtcgttttgtatgcaatactaatatacttcatctagtaatacaaaaggtacaagaaaaagaaaattgcacctggctatttgtcttaatatattatgctggaacatgacattgctatatgatacttcttttgcagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacctagagggggcgcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccttttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 9535 - DNA, 1743 bp, Zea mays
cccccacaaaccaccaccaccaccaccgaaaacgaatcccagaacagtaccgcagcggcagccatggtgctctcgcacgcgagctccggccgggacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtgggaacagtgggatcctcggaagcgatcatgcttgcaggtctagcgttcaagaggaaatggcagaacaagaggaaggagcaggggaaaccgtgtgacagacccaacatcgtcaccggtgccaacgttcaggtctgctgggagaagttcgcaaggtattttgaggtggagctgaaggaggttaagctatcagaagggtactacgtcatggaccccgtcaaggctgttgagatggtggatgagaacactatctgtgtcgcggcgatcttggggtcgactctcaccggagagttcgaagatgtcaagcagttgaacgaccttcttacagacaagaacaaggaaactgggtgggacgtgcctatccacgtcgacgccgcgagcggagggttcatagcgccattcctctaccctgagctcgagtgggacttcaggctgcctctggtgaagagcatcaatgtcagcgggcacaagtacggcctcgtctaccctggcgttggctgggtcatctggcggagcaaggaggatctgcctgaggagctcatcttccatatcaactacctggggacggaccagcctacgttcacgctcaacttctccaaaggttccagtcagatcattgcgcagtactatcaactcattcgcctaggcttcgaggggtacagaaacatcatgcagaactgccaggacaacgccgcgatactgcgggagggcatcgcggcgacgggccggttcggcgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggttt

SEQ ID NO: 9536 - DNA, 1928 bp, Zea mays
ccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgtcgttgtacttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagctgtgacgttatgtttctgacagtttatttactaatgagcacatctttaatttactag

SEQ ID NO: 9537 - DNA, 2243 bp, Zea mays
atttattaattaacaaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtgttcaccgggcataattcctacctcactgggaaccagctcaatagtgactccagtgacgtcccaattgtaaaggcgttgcagagaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacatcagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagccgagaataatcgcagtggcagcggaaacatagctgagttgccagaccaaggaagcctgagaagaatagattcaaatgccgatgaatctgatgggaaggatgaactggatgagcaagacgaggaagactccgacgaggacgatcccaaatttcagcaggatacagcctgtgagtataggaaactcatcaccatccaagctggcaaaccaaaaggccatttgcgggatgcgctaaaagtggatccagacaaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcagatggttgcgttcaacatgcagggccatgataaagcgctccggttgatgcaagggtttttcagagccaatgggggctgtggttatgttaaaaagcctgacttcttgctaagaacaggtccaaatggggaagtatttgaccccaaggctagtttgccagtgaagaaaaccctcaaggtgaaagtttatatgggagacgggtggcgcatggacttcagtaaaactcatttcgatgccttttcgcctccagatttctatactagggtagggatcgcaggtgtgaaggcagacagtgtgatgaagaagacaagggtgattgaggaccagtgggtgccgatgtgggatgaggagttcacgttccttctgacggttccggagctggccctcctgagggtagaggtccaggagtacgacatgtcggagaagcacgacttcggggggcagacagtcttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttcttcttttttttcccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagttttacttgctggcacattgtttgtttgtttactttactggagatagatttgcacatt

SEQ ID NO: 9538 - DNA, 2034 bp, Zea mays
agaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttt

SEQ ID NO: 9539 - DNA, 2784 bp, Zea mays
gtttttatgcagagtaacagaaattggatcaattcaagtaggtgagtgtaattgatccttttgaagattctgatcccagattaattcacgactagagttgtgaactctataggttttcttgtgtaaatttaacactaatttggctgctctttgggtctgggggcacaaatttgaaatattgggagtgctggtgtgatatagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttggtcaaaatgtattttccttatgttttatatttttggaaaggaaaataattgaaatattattt

SEQ ID NO: 9540 - DNA, 1099 bp, Zea mays
atcaagcctctcgtaaggaacaaggaaggtagctagctagttcgtcatcggcggcggcggcgcctgttcttagaggataaggttgtcgtagcggagagggagctagccaggattttggttgagatcaggagggggagcaggcggcggcggcggcgatggggcgcggtaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagtagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagagccagcttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcatgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttccccgtttatccgcctggtgcagtatagtatcatcgtgatcgcgagtcagcagcagtgggtttgccgtatctttttttttaccactgtatgtctatatgtaagtatcaaatctgcaatgtgttaatcaccatttccgctggggcggacgcacgagtatcaaatctgcaatgtgcagcatcaaatattcc

SEQ ID NO: 9541 - DNA, 2264 bp, Zea mays
cgcgagcggcagccctttgccttgtttggatactctagtattccccctaattcacatgtgttgagatatattggggtgtaaattagtttaatttatactctaataaacctcaacacacgtggattgcggtgaatactagagtatccaaataaggcctaaggggtattaaccccctcccccccaaaaaaagtcctgggaatctatttactgatttcacttatataggtgtagtgttaggaaacattttagcgtcggaaaacaagattttgaagcaattaagtgattttgtattttgtgctctttgaggttgtggaaaacaagactcgaagtggttgaagtgattctgaccagacctactgcattatgttttgagcatatctggtcgtgtagtgggtttatggcagtagggattcagtgctatcgttttcactcattagcgcatttgattgtaaacaaatacatccttgaaagtgtttatgatacattctccggtgaacctcatcttcaggtgaggcaaagagaggggagattaactctcccagcaaatttataatcctgacatggtttcttgaacttttttattgtagctagatggaacaagatactggatgaagtaccaagaatcagattgttttgttctagaagactctactgaccaccttcacatgctatagtatattgctggcctatcattatccctgttattgcagatataaatatacaaaagctgaaatttacagagaacctcatccaagcgaacataatgccttatgactgacctgctgatgaccatttctggtctattgcaacctgcagggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtaacattttcattccatttcttttatattgctggattagccaggaatgatgatggatctggcagacaaggtttgacgacccatccttctaaccatatccattatgtttgcgcagttgcatcttcagatttgccctcatcttttcttcttcttcttctgaaacattctaaattgctccttatccagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcc

SEQ ID NO: 9542 - DNA, 962 bp, Zea mays
gcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtg

SEQ ID NO: 9543 - DNA, 2775 bp, Zea mays
gttcagcccccaaacccgaacactcgcaatcgcaagtcgcaaatatctgtcgccgtctcgccaaacgccaacagcaccaaccgcctcctagaactcgaccgccatggcgagccaaggcgagccgtcttcctccgatccgaaggggaagaaggattactcgacggcgatcctggagaggaagaagtcgccgaaccggctggtggtcgacgaggccaccaatgatgacaactccgtcgtcgctctgcacccggacaccatggagaggctccagctcttccgcggtgacacggtcctgctcaagggtaagaagagaaaggacactatctgcattgtgctcgcagacgagacgtgtgaggagccaaaggtccggatgaacaaggttgtcaggaagaacttgagggttcggcttagtgatgtggtatctgtccatcaatgcccagatgtcaaatacgggaagcgtgtgcacatacttccaattgatgacaccattgaaggcatcactggcaacttatttgatgcctttctgaaaccatactttcttgaagcctatcgtcctttgaggaaaggagaccttttcctagtcaggggtggcatgagaagtgtagaattcaaagttatagagactgatcctgcagagtattgtattgttgcaccagatacagaaatattctgtgagggtgagcctattaagagggaggatgaggaaagactcgatgaagttggctatgatgatgttggtggagttagaaagcagatggcccaaatcagagaactggttgaacttccccttcgtcacccccagcttttcaagtctattggtgtgaagccaccaaagggcatattgctgtatgggcctcctggctctggcaagacccttattgctagagctgtagctaatgagacaggtgctttcttctttttgatcaatggaccagaaatcatgtcaaagctagcaggagaaagtgaaagcaacctcagaaaggcatttgaagaagctgagaaaaatgcaccttcaatcatttttattgatgagatagattccatagcacccaagagagagaagacccatggagaagttgaaaggcgtattgtttcacagctcttgactcttatggatggcctcaagtctcgtgcacatgttattgttatgggtgccacaaaccgtccaaacagtatcgatcctgctcttagaaggtttggtcggtttgatcgtgagattgatatcggtgttccagatgaagttgggcgccttgaggttcttcggattcacacgaaaaacatgaagcttgctgaagatgttgacttggagctcattgcgaaggatactcatggttatgttggtgctgatcttgctgccctttgtactgaagctgctcttcaatgcattcgtgagaagatggatattatagatcttgaggatgagacaatagatgctgagatactgaactctatggctgtttcaaatgatcatttcaagactgcacttgggacaagcaacccatctgctctgcgtgaaactgtgagtatctctagtagtagcctcttctgtatgttgtgataaatttctacttattccaaaagcaaccttgaacttctttttttcaggttgttgaagtgccaaatgtctcttgggaagatattggtggcctggaaaatgttaagagggagctacaggagactgttcaatatccagtggagcatccagagaaatttgaaaagtttggcatgtctccttcaaagggtgttttgttttatggccctcctggctgtggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcaggaaagacaaccccgaggccatggaggaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccccgaccaaccgacggcagctgcaggctctgctggtgcggccgatcccttcgcatccgctgcagcagcagctgacgatgatgacttatacagttaaattagcagccctgcgttgtgacgaatattgagtactttgcttcgttatatatgcttattatagtagactacgtgcaagacgcggagtcgctgtacctatatataatacttaagttaatattttggcacgatcctctgaattgtgccatgagcc

SEQ ID NO: 9544 - DNA, 1484 bp, Zea mays
gctccatgcctccatctctattcaccccgcgctttcgtttctcgagtgctccggttcctgagccgctgcttggtttgattgatctgggcgcgtcgagggatctgagcggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtctttgctcgagagctactcaggtgattttgtcgtgggagcaccaaaagcagaaaagaactgtttttttct

SEQ ID NO: 9545 - DNA, 1680 bp, Zea mays
cgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatgtggggcgagagaactcatcataagcactggcatcaaggtcatggtacctcggggaattccaacaacaaaaagcatgataagcggcagccaaaatttataccagacaattatagctccgtcgatgaggttactactgctctgcgagaagctggcctcgaatcgtcaaatctaatcctcggtattgatttcaccaaaagcaatgagtggtcaggcaggcattcctttagaagaaaatctctgcatgccattaatggcaccccaaatccatatgaacaagctatctctataatcgggcgaacgctgtcaccttttgacgatgataacttgataccatgttttggatttggcgatgcttctacacatgatcattctgtgttcagtttctacccagagaaccgaccctgtcgtggctttgaggaggttcttgtaaggtatcgacagattgtaccacatttgaacctttcaggaccaacttcttttgcacctcttatttatgcagcgatttctgttgttgaaaacagtaattggcagtaccatgtcctcgtgatcatagctgatggacaggtgactgccgcgaatataaatgatggaagattaagtccacaggaacaagcaactatacaagcaattgtcgatgctagctactatcctctttcaatagtaatggttggggtgggtgatggaccatgggatgcgatgcagcattttgatgactgtatccctgaaagagcttttgacaattttcagtttgtgaacttcactggtattatgtcaacaagtaaggatatgtcaaagaaggaggctgcatttgcccttgcagctcttatggaaataccttctcagtataaagcaacgcaaggcctccgacctccagaaaagcaagcacaaaggattggctctcctaggattcttcctcctccaaataaagttcttgaaaatgataatgccgccgccgctgcttcgcaccctcctcaaactgcaagctcgaaatcaactggtattggcaaaagtgctgctgacgagcaggtatgccccatatgtctaaccaatccaaaggacatggcttttcagtgtggtcatctgacatgtaaggaatgtggcccaacactatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaac

SEQ ID NO: 9546 - DNA, 2275 bp, Zea mays
ccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatctggtcaagaagcactctgagttcatcagctaccccatctccctgtggactgaaaagacaacagagaaggaaatttctgacgacgaagacgaggaagagaagaaagatgctgaggaaggaaaggttgaggatgttgatgagaaggaagagaaagaaaagaagaaaaagaagatcaaggaggtttctcatgagtggtcattggtcaacaagcagaagcccatatggatgaggaagccagaagaaatcacaaaagaagaatatgctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttcccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctacctgtgatagcttaattttcactattgttcgaggtttttggcacgttatcggttgtcctgctggccaggctataagtctggtttatctgttatgtttaccctttttaacagtttgtcgttattattcgtaatggtaaaaatgtagt

SEQ ID NO: 9547 - DNA, 2709 bp, Zea mays
ggagctggccgcgtcgtatcgactcctgccgccgaaaggccgagcccgagcccgtgtcccggtgcccgttcccgcaaccctaatcccctaccaccgtcggctctcgccggcgaagaagagggagccgcgcggcgtcgccagggagcacgcgccccctcccttcccggctccctccgcgccgtggggaggcgcgtccacccggatccgccctcaccgcgaggcagaggggaggagagggagccaggtccggcgcacccgctgtcgtccgcgccgaagagcgttaagagtctccccacaggcttggctgagggaaacttgtgctctgcgcatcttggacactacttcaccatttaccaagtcttgagttattgctccggtgccagacaaaaaaccaaactctctggccgaacacagtgatggcgcaagcctgtaagaagaggagaggagtttatataagcagtgaatcaggagactctgatacagattctgatgttgagggaagcaaacactctcaaaagtctggggtgacatcaatttctacatgcgagcaccagtcatcttataacctcaaggctgcaagtatgaaaagtagcaggatgataaggctgtgtggaaatatcgtaaggaagctcatcgatcacaaatgtggctggcttttcaaagaacctgttgatccagatctatatgggattccagactactttgatgttatccgcagtccaatggatttgggcactattaagaataaactcacaaaaaagaaatatgtaagcattgaggagtttgcagcagatgtgaggctaacattttcaaatgctatgaagtataatcctccaggcaatgatgtgcatatttttgctaaagaattgaatgaaatgtttgattcagaatgggaatcagtagaaaggaaatttagaggccgaaaccttggtcaagaccagcagacaatgaaggccataaaagttcgagctatgatggattcaaagtctacagttgctagagggccggttgcatgctcaaaccctaaaactttggttactagaggtccagtagcttgctcaaattcgattgcaaagaagacactgacagatgcattatcctccaaagtaaaaatcaaattttccgtgcgcagctctgcgcatacctcttccaaagatatactcgttcaagcagctggtagcaaagaggggtccttaaatcactctgtccctactggcaacaaagaggcatcttcaaattgtactattcctatcgctaaggaggctaaaatatcaagggcacgagaaattgagcgctgctctggttcaattggaaaacaatcatggtcttgcaatgacacttctacttcacctctcgcttcctctgtgcaaggtgaggaaagttaccttcatgatgaacctttgtcaccaagcagggctcttcgtgcagcaatgctcaggagtcgttttgctgggactatagtgaaggctcaacagaaggcacttctagatcatgggaagaatatagaccctgtgaaattgcaattggaaaaggagaggctggaaaagaggcagcaagaagagaaagcaaggatcgaggcccaggtgaaggctgctgaagcagctgcacaacaaaagtttgaggaagaaatgaggatgaagagaaagcaggaaagggaggcagcacgcctggcactacgcatgatgaagaagactgttgatattgacaacagtgacttcctaaaggagctggagaacttcagcaaaacatggcaggcaaatccacctggcaaattaatcgtggattttatcagtggggacttgccaccggggttagggagtccgctggagaggctcggcctcttcatgaaggaagatttcgaggatgaggtagaacaggaaatggaggacagagtgtcaccctcaatggatgttgacatcaggaaagatttccaggaagacttaggacatgaaatgcaggacagtgcatcacccgtgactgtcattggcacaaagaatgacgtacagggagtggcaggacatgaaatggaggacagcggatcaccagccacagtcattgacacgaagaaagaagagacagaacatgagatggtggacagcgtatcacctttgatggatgttgacacggaggaaggggagatcagctgctgacggtagctacacctctcttcacccgcataatttattgaggcagacatccttgcttggttgttagattaggcaatttcataagcagagtgatgcagaaacattagttttatctgctttcatcgtagaaccatgtggtgtggagaacatgtctcagacgaaatgacgagtggttttggatttgctgcggattttaattttcgtggtcttgtcagtctggcaagagtatgatgactctgtatgttgaatttgacctcccccgctggatgacatgtataaaaggatgagaaaaaaaggatagtttggagctagtgtatgttgttggagtttatggtggagccagatttggtgagcgtgtcgtggacgtaaatgtaggtatagctatatacttgaaatattgataagagtgtttggttcaaaggatcaattcattccagttaaacatcatgagcttgttaatgggtgtttggttcgagagttcgttaatgggtgtttggtttgaggaataagctagtctactattttttttatttggttgttgaatgtaattttttgacctgtc

SEQ ID NO: 9548 - DNA, 2037 bp, Zea mays
gaaagggaaggcgaggaggaggatggccggaggaggggcggcgacgccgccgaagcaggaggagctgcagccacacccggtgaaggaccagcttcccagcgtgtcctactgcatcacaagcccaccgccctggcctgaggctgtcatccttggattccagcactacattgtgatgctgggcacatccgtcatcataccaagtgctcttgttccccagatgggaggaggaaacgaggagaaggcccgggtgattcagacgctgctgttcgttgccggcatcaacaccctatgccagtcattctttgggactcgcctcccagcggtgatgggtggatcctacaccatcgtcgcacccaccatttccatcatcatggccggccgttacagcaacgaagcagaccctcgtgagaaattcttgcggaccatgcgaggaacacaaggcgctctcatcatcgcgtcgacaattcagatcgtgcttggtttcagtggcctttggcgcaatgtcgttaaattgctgagcccattgtctgctgtacctctggtttcgctagctggatttgggctatatgagctaggttttccaggggttgctaagtgtgtggaaattgggcttccggaaatcatcctaatgctcatattttctcagtacttacctcatgctgtccatgcggcaaagcctgtgttcgaccggttttctgtgattttcacaattgcgattgtatggctgtatgcgtacattctcacggttagcggtgcctacaagaatgcccgaacaaagacacaactccattgccgagttgaccgctctggacttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagtgcgactatgatacctccttcagttcttggtcgtggcattggttggcagggcatcggtactttactgggtgcgttttttgggacagctaatggaactgcagtgtcagttgagaatgctggtctgcttgctttgacacatgttggcagccggagagtagtccagatatctgcaggcttcatgatcttcttctctgtccttgggaaattcggggcgatctttgcttcaatcccactgccgatattcgctgccctgtattgcattctctttgcatacattggtgcttgtggcctgagcttccttcagttctgcaacctgaacagcttcaggaccaagttcatcatggggttctccttgttcatgggcctgtcagtaccccaatacttcaacgagtacacgtccgtggctggctatggccccgtgcacaccggcgcccgatggttcaacgacatgatcaacgtgcccttctcgtcgaagccgttcgtggctgtgctggtggccttcttactggacaacacgatccaggtgcgtgacagcggcgtgaggagggacaggggctaccactggtgggacaagttccggagcttcaagacggacagccgcagcgaggagttctactcgctgcccttcaacctcaacaagtttttcccttccgtctgatcctgcagggtctgcacactcttcctcgcagccgcagtagctcgggctggagtcaggcaagaaatgatcctatgcagatgatgctggagcatggactgatggcgttttgtacattcaggggtgaactgaactgtgcaggttgcaggggatagtgctctgggtagcatcagtattccctagtaaccgaaattgaaaaggccgcctgttaaacttctgcaaacactagcatgattacgtctcctagtgctactgttgtttagattggaaaacatggaactcaacggtaagcatagatttaccttgaagcaacccttttcttttgcttagaaagaatttgtgttggggatttttttttcaccatgtaagaactgagagcacttagattacaagggagggtgaataggtgatcctgc

SEQ ID NO: 9549 - DNA, 1145 bp, Zea mays
cacccgcgtgccggggcggaatggcccggaggcgggcgtgatgcgtgatgcgcgctgcgcgatttatacgcgccaaccacgccagttgctcgctctgctttgctcccgttcccatgctgatttttttaggcggctgctggcctgcctgtctccactggaagctccggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagatgagagatctctgcatgattctccagtcatgtgatgtgtgtatgtatgcaaaatatgtatgtataccatcatggggtgcactgacgcttacattggacatatgtaattatccagtcatgtgatgtgtatgtacgcaaaatatgtatgtatgccatcatgggatgcactgac

SEQ ID NO: 9550 - DNA, 1085 bp, Zea mays
ctccgcttttgcttggttccatcgggccggagaggaggagctagctagctagcagcagctctgttggtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtatttgtatctgttctgtgt

SEQ ID NO: 9551 - DNA, 1829 bp, Zea mays
acacacctggcaacctccctagacctggagcgcacgagagagagatagaagagagacggaccgacgaccgacggcgatctcgatcggtaggcagccgttgcttcttcttgcttggcgggcggggcggccaccatagccctctgtagctcttgccggctttccttgtgctccttggaatctcgccctgcatatcttgtactacagtagctagctcctctgctactgtagagctacaggcaagagggaagcaggcagcgaccgagctctagctgccggctgtgcgactgcgagctagagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcctacttcgcccggccttcaggtttggacgccgccagggaggagcccgccgaggcctctgcctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttggggcatattcgaccgtttaaagctgtatgcacgcgtcgaatttcggtgtggtttctgcatgccggccttaatgtttttcagcttttgtttgcacacgaacgctttagagcaagtttaataatagttggctctaact

SEQ ID NO: 9552 - DNA, 889 bp, Zea mays
aaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttttcgaattttggcggcatgggtggtatgggtggcatgggtggtatgggtgatatggctggcttgggtggtcttggtggcatgggtggaatgggcggtatgggtggtatgggaatggatgattttgaggatgatagtgatgaagaagaagtgtcgaaacctcaagctgccggacatgctgctgaggccgagaagactgagtcggcggaagccaagactgagtcggctcagagcagttgaagatgctttcgacatgatctaaactagttgtatcgtcaagttaattctgctgaatcgatggacaaacttctacgttgttggcactggccgatcccagtgacttgccctaaaatttacgttctgtctttacatgggcatcctagtgttgtgctcatcacattattgatattgtttctgtgatgcttcctttggtcgacaatcatgtgctggagtttggttt

SEQ ID NO: 9553 - DNA, 1223 bp, Zea mays
ctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatgcagggttggtggcaaggaaaacttcttccactgtgtgaagtgtgggtcctgctattctgttatactccgtgataaccatcagtgtgtggagaactcaatgaggcagaattgcccaatctgttatgagtatctatttgactcattacaaggaacaagagttctgaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacaacatcgcgccctgcagatttatccggaagcagctcaccttcaacagactcatccgacaacaacatatagagaagaaaccattgacagagccaatatgattgaagaaccggaggaggaaacattgtttcggggcgtgcgtgcttgccaaacttgaagactcccagccgtttattggccctcatcttgtctagattcagttcattccatgagtctttgctgttctggcaacttccagcttgcgcatcgctgggtcaacaacccacatggccggcgtagctgtccctttgaatcttgttcgcagccgtgattttatcactgtggatgaaacgtaatcacatacttactgtaatctactatggttgaagatgtgtgcccccctgactc

SEQ ID NO: 9554 - DNA, 2430 bp, Zea mays
aacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagctttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgc

SEQ ID NO: 9555 - DNA, 904 bp, Zea mays
gttggcttctcctccccctccggttcgggttcgggttcgtgaggttctccggggttcggtttcgtgggtgagcggatcgagatggcggcgtcggatgttgagtaccgctgcttcgtcggcggcctcgcatgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgcaaaatggttgtgctcatctgaaaagctacttactctcgctttgagtgcgaataaggcaaaggttgccagtttttcaaac

SEQ ID NO: 9556 - DNA, 1017 bp, Zea mays
gaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcagagcctggcgtcgtacggcgggtcgccgccgccgcggagcccgcgggagctggcgcgcgccgcgctgtcggtgagcgcggaccgcgcgcgcgccgcgtcggcgtacgtgggccgcctgtgcggcgccagcaacggcaaaggcgcgaagaaggggtcgggatcggcgtcggcgtcggcgtcggcaggtcccgtgcgcgactgcctggacaatctggcggacagcgtgggccacctccgcgacgcggcgcaggagatgggcggcgccgggatgggccgcgcggggacgccggcgttcaggtggcacctcagcaacgtgcagacctggtgcagcgccgcgctcaccgacgaggacacctgcctcgacggcctctcgtcccgcgccgtcgacgccggcacgcgcgccgccatccggggcaaggtcgtcgaggtcgcgcaggtcaccagcaacgcgctcgcgctcgtcaataaggtcgggcctgggtactaacacggggaggggacccaagatccaggcccaggcccagcccagataccacacccgctactagtatagtactaggcgcctccacggcgttgggtgtttctcgtccgttaatagctcggtttgctttgcttgtgtttgtgtaagatatacattagttaagggcaataagcttgtactattatgagtggcggccgaggagtacagtacgttctcctctgtccgatcatgccatcattaacattaattaatgtggg

SEQ ID NO: 9557 - DNA, 1133 bp, Zea mays
gctccaccacccaactccttctgcctgtgctctcctcctttttctccactccgcttttgcttggttccatcgggccggagaggaggagctagctagctagcagcagctctgttggtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtatttgtatctgttctgtgt

SEQ ID NO: 9558 - DNA, 2279 bp, Zea mays
ttaccctattacctttctgctcgtggtgagtgctgacaccacctcacgcacacaagccgccggcggcgaccagaccgaccacctcgcgcactagccttgctcgcttctcgtcgccggctcgttgccggctcgtcggcacgatgtcgtcggagcctccacccgccccttctgccgccgcagcagagggactggctgctgacctttccgccgccaccctcagcaagaagcagcagaagaaggacgccaggaaggcggagaaggctgagaaggcggcgcagcgccagcaacagcagcagccggccgacgccgaggacccatttgcggccaactacggtgatgtccccgtcgaggagatccagtcaaaagccatttccggccgcttgtggtcccagatcggcgacctcgacgactcctctgcggggcgctctgtgcttatccgtggatccctgcaggctatccgcccggtcagcaagaagatggctttcgtcgtgctgcgccagagcatgagcaccgtgcagtgcgtgctcgttgccagcgccgacgccggcgtcagcacgcaaatggtgcgcttcgccaccgccttaagcaaggagtccatcgtcgacgttgagggcgtcgtgtccctccccaaggagcccctcaaggccaccacgcagcaagttgagattcaagtcaggaagatctattgcatcaatagggctatcccaacccttccaattaaccttgaagatgcagctcggagtgaggcagattttgagaaggctgaactggctggagaaaagcttgttcgtgttggtcaagatacccgcttgaactacagagctattgatctacgaacaccctcgaatcaagccatattccggatccagtgtcaagttgaaaacaaattcagagaatttctgttgtcaaaggactttgttgggatccacacgccaaaattgatttctggatccagtgaaggtggtgcagctgtattcaagcttctgtacaatggtcaacctgcttgcttggcacaatctcctcagttgcacaagcagatggctctatgtggtggttttgaacgagtatttgaggttggccctgtgtttagagcagaaaattcaaacacacacaggcatctctgtgagtttgttggtcttgatgctgaaatggagattaaggagcattattttgaggtctgtgacattatagatggcttatttgtatcaatatttaaacacttgactgaaaactgcaataaagaactcgagacgataaacaggcagtatccatttgaacctctgaagtatctagacaaaacattgaagctcacttatgaagaaggagttcaaatgttgaaggaagccggaacagaaattgagcctatgggtgacctcaatactgaagctgagaaaaaacttggtcggcttgtcagggaaaagtatgacacagattttttcattatgtatcgatatcctttggctgtgcgtcccttctacactatgccttgttatgacaacccagcttacagcaattcttttgatgtctttattcgaggcgaggagataatatctggagcgcaaaggatacacactcctgagctgttgaccaagcgtgcaacagagtgtggaatcgatgtcagcactatctcgacctacattgaagtcttcagctatggcgcgcctccgcatggtggtttcggggtgggtttggagagggtggtgatgctgttctgcgccctaaacaacatcaggaagacctcgatgttccctcgcgacccgcagaggcttgtgccgtaatttactgagtccaatgccctgagtttgcagcagagcgtactggttgttttgatgttctttgagcatcgaacatcgctaacttgcaatctcagctactgaagccccggttaccgtggttcagagttcctgttaaattcacaaagctacttgtatctattagattgctgaaaccagcaagtacgatcctttttgggatttgatctggtctaattgttgttaagtggaggtattgctctcagtttttttgtgctctgtttgtcggcatatgccaagagctagggcttcttaagttctaagtttttagacgagtggattccttttttttaagagccggcaaaagttctgccctgcacctgttaaaaatagatattaccctgttccaattctaaataatatgacgtgtcgccttctagatatttatattatgtagatgtacaatatgtctagatacagatagtaaagtaatgtatgtctttataaagagagaagaattgtgctgcg

SEQ ID NO: 9559 - DNA, 2674 bp, Zea mays
ggcacagataactctagcttcttcaaggagaagcttacacaagcccttcggtacttcaaggagtccacagatcaacatctgttggtccaagtctgggcaccagtcaagaacggagaccgctatgtgcttactacttcaggacagccttttgtgcttgaccaccagagcattggcctacttcagtacagggctgtatccatgatgtacatgttttcagttgatggggaaaatgctggagacctgggcctacctgggcgtgtctacaagcaaaaggtgcctgagtggacaccaaatgtgcagtactatagcagtggtgagtatcaacgacttaaccatgcgatcagttacaatgtccatggtacggttgccctgcctgtttttgatccttctgctcagtcgtgtattgctgtcgtcgaacttataatgacatcaaagaagataaactatgcctgtgaggtcgataaagtctgcaaagcacttgaggcggtaaatcttaaaagcactgaaatactggaccatccaaatgtccagatatgtaatgaaggccgtcaagcggctctggtcgaaatactagagatcttgactgtagtatgtgaagagcacaagcttcctttggcacaaacctgggttccttgcaagtatagaagtgtattggcacatggtggtggtttaaagaagagttgcttaagtttcgatggaagttgcatgggggaagtctgcatgtcaactagtgatgtggcgtttcatgtgattgatgctcatatgtggggatttagagatgcatgcgtggagcatcacctacagaggggacaaggagtttctggaaaggcatttatctcacacaaaccttgcttttcaaaagatatccgcaagttctgtaagttggcatatcctcttgtacactatgctcgcatgtttgggttgtctggctgctttgcaatatgcttgcaaagttcttataccgggaatgacgactacatattagagttctttttgccactcgattgtattgacgaagatgaccaaaatgccttactggagtctatattaactctgatgaagcggtgtcttcgtagcctaaagctagttgatgacaatgatttgagtggggtttctcttcaccttagtaatgtgctaaaacttgagaatgaagaatccaaaacagatgcacagtttgatggttcccttcgcgaatcacctgaggatgatagacatggaggatcccacaagtttgataatgagaaccagaaagttttggatatcacagagggacaattgttgactgatgactactctcaagacaatggtacttctgttggcagaccaaatggtagtggtgcttctgattcttcattgcttcacaaaaccaacaaaccccctgaaagaagacgtgggaaagctgaaaagactatcagtttagaggttcttcagcaatatttttctggaagcttgaaaaacgcagctaaaagccttggcgtttgtcctacaaccatgaaacgcatctgccggcagcatggaatttctcgttggccatctcggaaaattaataaggtcaacaggtctctctcgaaattaaagcaggtgatcgagtctgttcaaggctccgatgcggcatttaatctcacatctatcacaggtcctcttcctatacctgttggcccttcaccagagtctctcaatgtagagaaattaactcaaagtaaagtggcagaactttcgaatcttgctgttggtgttgacagagattctttgcagaagtcgcttgaaaatgatgaccattttgatatagtcatggcccagcaaggatttatagacaataacaatgacgtgcagcttgaagctgacaaagcttctcactcgagaagttcatctggagagggcagcataaattcacgcacttcagaaggctcatgccagggaagtccagcaaaccaaacatttgtttgtaagccaatcgcttcaatgttcgcagaacctcaacttaatcaagaggagttcaacaaagaaccttttcaagaaccacaactaccactttcaaggatgctgattgaagattctggtagctccaaagatttgaagaatctcttcacttcaacatcggaccaaccatttttggcccctcccaacaacttggtgtcaatgaagcattcagggactgtaacgataaaggcgagttttaaggaagatattgtgaggttccgtttcccatgctcaggtggtgttattgtattgaaagaggaggtagcgaagaggctaaggatggatgttggcacgttcgatatcaagtatctcgatgatgaccatgagtgggtaaagttggcgtgcaatgcagacttggaagaatgcatggagatctcgcggctttctggcagccatgtcattaggctactggttagcgatattgcagcacactttggcagttcttgtggaagctctggttgatatgcgtgtcagccttttgctttgatcaatgtagactcgaaagttcagttccacttggtagttttgttgctagttagctttagctgtttcattgtgtttgataaatgtatcattgtattttacccccaaaaaaatacatgtaattgtgcagaacgcacttgtagtcaactttgtatatatcatgtgctggaaattctatttcaagttataaaaactgaatttgttattgtct

SEQ ID NO: 9560 - DNA, 2092 bp, Zea mays
agttacatgacctgtttgaacagtaacactgggacttcttctgaccctaaaatattagccgaggcttctgatggcctggaaagagtcaagagagtgatcgattgggtatccctgtgcaaggaacttattgagaaaaaaacatctcctgaagcaacaaaagccttagaattgatctccaatgcattgcacatatgtccatattcagacagcctcaaggagatgaaggcagagacattgctgatgctacgaagatacgaagaagtgattcaactatgtcaggagtctgtaaatccgactgaaagaaagccagctttattcaaagataatggagaaccaaagaattccagtctctttgaacagacacacttctctggaaggtattggcgaccctatctcatttgcaagtcttatttcctttcaggcaagctggatgaggctgtcgaattattaaagaaacatgagcaagtcacacctgtcaaagaaagtgacgtgaacacatatcaagaaaatttctcatcattgtcagcgattataagagaactactttcccttaaggctgctggaaatgaatcatttcaagctggtagatattcagatgctgtcaaacagtattcagcagctttggcatgtaatagtgaatcgcgcgcattttcagctgtctgtttttgcaatcgcgcagctgcgtatcaagcactcggtcaagttactgatgcaatagctgattgttcacttgccatggttcttgatacaaattaccccaaggcaatttcaagacgagccaccttatacgagatgataagggattatggacatgctgctaatgatttaaggaagctaatctcacttcttgaaaagaaagtaaatgtgtctggaatatcaccaaaagcttttaacaagcataaagatatcaagcaagcacatgcgaggctttcacacatacatgctgaagcaaaaaacgatacccccctgaatttgtatttaatcttgggagtggagccatcctgctcttcagcagatattaagaaggcataccggaaagctgcattgagacatcacccagacaaggctgctcaattattagtaaggaacgagaatgctgaagatggattttggagggatgttatcaaggaagtctatgcagatgcggatcatctgttcaaaacaattggggaggcatataatgttctttctgacccggacaagcgtcaagagtacgactttgaagagaatctaagaaatgctcggagagtatcgagctcaaggagcatgcgtaggtcacctgaacataactacagcgacagaggctttaatccacggcagtggcagtcaagcagagcatcacgttggtacagcaaatcagacgattactggtaaagaagccactacggcgtggtcatgtggtgagaagcaacttttgcaactatgtcatgtgtggagcaaatgcctccttgcaccaaagatgggatgggatgcacctgccttcccgggttgtttaggtgccggtgctaatgcaccagccttgcagtcagcagctttcctgtttgtttgctgcgtttctttttcagaggatggaaatattaggattgatcaattggggatctgggatgattgcttgacactggtagcgtcgtgacttgactagcacagcaaatatggaggattaggaagtggtatatcaaatagtcttttgttggcctggtgatgtctgaacactgactgcttgggagtggctggcatgatgttatccgctctgaagtcaaaacactgagaacaacatcaaaggttagaaatctgggtaaagatgccagtttgtccaataggtacaggcattcttttgctgaatgcagggcccgctgtcgtaagtttacagcagatcagctgaaagaaaagagacaggttcttctgtttggcgcgtgcgcgtgcagttttgttctgttgtttccttattaccaaatgatgtagcgttggaaagagttggaacatattgtaactgcccaatgttgaaatctcgtaacatttatttattctttattactagacttgttagccaaatgttggaagcattttaaggtaatcaaggttccttcaaagc

SEQ ID NO: 9561 - DNA, 2658 bp, Zea mays
ggtctttgtaggttcagcgttcaggaactaagtgcaagaggaccataccatgtcgcccgtgtttcacgccttgacatgacaaagactgaattggagcaggcagagcaagacccagatcttatcgctctttctaggcagtttaaagctactgccatggaactaatttctgttctagaacagaagcagaagacggttggtagaacaaaggtgcttcttgatacagttcctgtttacaggctagctgatatttttgttgctagctttgagataagttttgaggagcagctttcgatgctggattcagttcacttgaaagttagactctcaaaggcaactgaacttgtagacagacacctgcagtccattcttgtagctgagaaaataacacaaaaggttgaggggcagctatcaaagtcgcaaaaagaatttctactgcgccagcagatgagggccataaaagaagaacttggtgataacgatgatgacgaagatgatgttgctgctctggaaagaaagatgcagaatgcaggaatgcctgctaatatttggaagcatgctcaaagggaaatgaggcgcctacgaaagatgcaacctcagcaacctggttatagtagctctcgagcctacttggaacttcttgctgaccttccttggcaaaaggtcagtgaagaaagggagcttgaccttagagttgcgaaagagagccttgaccaggatcattatggactaacaaaagttaagcaaaggattattgagtatttggctgttcgtaagcttaaacctgatgccaggggtccagtgctgtgttttgttggaccacctggtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgcttctagatgaaattgacaagactggttctgatgtacgtggtgatcctgcatcagcactactagaagttcttgaccctgagcagaacaaagcattcaacgatcactatttgaatgtgccgttcgacctgtcaaaagtcatatttgttgcaactgccaataggatgcaacctataccccctcctctgttagacaggatggaaatcattgagctgccaggctacacacccgaagagaagttaaaaatagccatgaaacatctcataccaagggtattggagcagcatggcttgagtacgacaaatcttcagattcctgaggctatggtcaaactggtcatcgagaggtacacgagagaagctggtgtgcgcaatcttgagcggaacctagctgcattggctcgtgcagctgctgttaaggtcgcagagcaagttaaaactcttagacttggcaaggaaatacaaccaattactacaacccttcttgattcaaggcttgctgatggcggtgaagttgaaatggaagttattcctatggagcatgatatatcaaacacttatgaaaatccatctcctatgattgttgatgaggctatgctagaaaaagtacttgggcctcctagatttgatgacagagaagctgcagatcgtgtagcaagcccaggagtctcagttggccttgtctggacttcggttggtggggaagttcagtttgtggaggctacagccatggtgggtaagggtgacttgcatttgactgggcagcttggtgatgttattaaggagtcagcgcagctagctttgacatgggtgagagcaagagctgctgacctcaatttgtcacctacttctgatatcaacttattggagagccgtgatatccacatacattttcctgctggtgctgtgccaaaggatggcccttctgcaggtgtgacattggtaacggcactggtgtcgctttttagtaacagaaaagtcagagcagatactgctatgactggcgagatgactctaaggggccttgtattgccagttggtggtgttaaggacaaggtacttgcggcacatcgttatggaatcaagagagtaattttacctgaaaggaacttgaaggacttatcagaggttccattaccaattctctccgacatggagattctgcttgtgaagcgcatcgaggaagtactcgaccatgctttcgaaggccgatgcccacttagatcacgctccaagttgtagcacccaagtcgcgtttggtatggatgtttgcttgagaggatcatcgtcacagtaccacgaatggtcaacagtgtgagagtaagagcctagctctcttgccagcacaggtcttggcacgcccttttcggtttggcttcgcgtctggaatgtgtatacaggattactggtcagaattctgagaataacgagaagattctctgctgggatagtgggattccctgcatatttatgtgaaaccagctgtcggtatttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaatatcatacgtacttt

SEQ ID NO: 9562 - DNA, 1521 bp, Zea mays
cggagattcccctccccagccgtcgaaagtcgaaaccctagccccgcctcaccgccggtggtggtggcagcctcagcaccggcacacagcccgccgtacctctcctcgtacgctccctcccggtgtgccgtcgccccctcgatcggtccatcgttcgtcggctcggtagccgccggatcgggatcggccggcgccatgtccaaggccagggtctacaccgacgtcaacgtgctgcgccccaaggagtactgggactacgaggcgctcaccgttcaatggggtgagcaggataactatgaagttgttaggaaagttgggagagggaaatacagtgaagtctttgagggtattaatgttaacaataatgagaaatgcatcattaagatcctcaagcctgtgaagaaaaagaagatcaaaagagaaattaaaattcttcagaatctttatggaggccctaacattgtgaagctgcttgatattgttagagatcagcattcaaaaacaccaagcttgatctttgagtatgtcaacaacacagatttcaaagtgttgtacccgacactaacagattatgacattcgatattacatctatgagttactcaaggcattagattactgccattcacaaggtattatgcaccgagatgtgaagccccacaatgttatgatagatcatgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaaagactggtgctaaccctggatcagatcatctgctcttggtggagccatgctcttaccagtgacttgcttcagtcgtatgtgatgaatagtggtttgggggtttacttggcaaaaacaaacagtagctatggcgcctgttgtgcccttaaccgcgtcgagacgtgactgaattactcaggtcatcggcttgtgggacgtgattgcgaacgagattattcatgtaagatgtttgccataaaaggttgtcgttggctgattgttttgcttgtattgttgagcttgtaaagaatatccaacatttgtttggacttc

SEQ ID NO: 9563 - DNA, 873 bp, Zea mays
ggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgcccgccgttccaccacgtcactgtccccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaaataaaatgttggcatgcgtggtgggatgctatcctttatttttattttattttattttttagcttggatcagttggggttttgaacattgctagtgtcgtgtgattgggaaggctaatgtgatgccttccatgcagagttttcaatgaatgccttggtgcaaacgtacgattgtgtaat

SEQ ID NO: 9564 - DNA, 1557 bp, Zea mays
gccaagtgtaaagagtgcgaagaagcagtagcaaaaggattccattctcgtgttcttggagtggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatatt

SEQ ID NO: 9565 - DNA, 1516 bp, Zea mays
tagggcccacgccccgtccgcgctctccaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtccggaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttatatgcgctttgtgcttggttg

SEQ ID NO: 9566 - DNA, 1899 bp, Zea mays
gtccggacaaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcctccatggcgagcgccggcaacagcggcagcggggacgacgatgcaggagggaagctcctggcggatcgctaccagaagggcgaggtcctcggcgagggcacgtatggagtcgtcttcaaggccatcgacaccaagactggaaatacagtcgcggtaaagcggatccggataggaaaggacaagaaggaaggtgtcaacttcactgcattgagggaaattaaactacttaaggagctgaaagatcctaatattatagagctgattgattgtttcccttacaaggaaaatttgcaccttgtgtttgagtttatggagaccgatctggaagctctcataaaagataagaacataatactctctccagctgacacaaaatcatatgtccagatgatgttaaaaggtctagcgttctgccataagaaatgggtgctacacagggatatgaaaccaaataatttactcattggtgccgatgggcagctcaagcttgctgacttcggtctggcccgtgtgttcgggagtccaggaaggaacttcactcaccaggtctttgcacgttggtaccgggcaccagaattattatttggctcgaagcagtacggatctggggtggatatttgggccgctggatgtatttttgctgaactgcttactcgcagagcctttctccagggttctagtgacattgatcaacttgggaagattttcgcagcacttggaaccccaaaatcttctcaatggcctgacatggtttatcttcctgattatgttgaataccaatatgttgctgcacctccactacgtacgttgtttccaatggccagcgatgatgctttggatcttctgtcaaaaatgcttacctatgatccaaaagcaagaatcagtgctcagcaggctctagaacacaggtacttttcatcgttacctgcaccaacaagaccatcgcagcttccaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacagtgcggacaagtctcgtttaaaacggaaacttgatatggatccagagtttggatacgcggagtagaaggaacacatgtttacatgcaccattcttttcttattggggatgttgatttttaaaataagattctgacacaatcaactgagatgttaccgtcatcgcctcacgaagaggaaaactgaagagagattattctaatttatcccgagtcacatagggtattacagctaaccaattccgtaaggaaggctcttgaaaacagtagactcaatgggatattcatgagtggagagtgttatggggaattggaggatggaaaagcttgctccatgcgtgtttgtacgtgttttgccaagattgtgctgaagcatctgatctatctactgattctctattttccgtactgtcaattcccgttcttgtatggacagagctttgagcatgttttcagtcagacaccttaggcacagtgattcttattgt

SEQ ID NO: 9567 - DNA, 3344 bp, Zea mays
ggatcctccagccctgcccacgaccacctctctccgccgaaaatcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggtaagcatgcttatgtcttcttgtttctgtcccaacgaatttatttattggttaccctgtgctgattagcactttactccagtttgttgagtgagatttaagagtctgcagtatacttgattcacttatttgcattgctactgcaactttttagttgttagtcaattttgttgtacctattgtacatggtggaatccgcagaaagcttttcatcatcaaactatgccttttttaaaaaggcaatttactaacagtttacctacacttggaatttatttagaagtctacgctttaagatgattgcgtagctaacagtataattatttgagtgtgaaacaaatgattaaatagtgaagttttagttaaacacaagccttggttaattagtttcataaaggcgaagcaacttaatccggtttccggtctacttgttctggaatggttctggcaaaaggtgatctgcttaaatgaaggtaagaaacagtttattatgttgaaaggcctgcatttcatatttaattgtttttagagttgagtgcattttaacatggcttagccgtccactaaaggagttcttttggtgttctgtgagcacatttctaatggcagttcttatttagctgtcctgaaggttactgggtcaattggtgctcttcaatcaaaagtttattgcctgtttagattctgaagctggccatctatcattcctagttcttgtgaatcacagtagtaattccatgatactttaggatctagaagttgggatgcatttttatatggatgatctgcacacatgatactacatacattgtgcacacatcttatcttcttacatatcttccagttgagattgaagaaaacactgtgtttttttttctcgaacacgcaggagaactgcgcgtcattatattgaaagagagaaaggtccgaaatggaccaaagtacaaagccctaacaggcaaaaatacatagaaaataaaacagtatagcctcatgcactaggaaaagccctagcccccctagcaaatgcagccagaaaacactgtgttgagcaagacttgagagcatgcagtatgcttgattcacttgtttgtatactacaactatccaatagattttattgtatctgtcaatgatttctagtcgcctggtcgaaccctgggaccgaccaggcaactagtcgcgattaggcgacgactagggcgactagtcgactcctagtcggtccctggtcgtcctacactagtagctatacttatataggtatatatataaatatacatgtatacattatataaattagagactgcagtagtgcatacattatataaattagagactgcagtagtgcagcaggctgcaggactccaggagaaggggcagggacgcagggtgctgtagccgtcggcaatcaaagtccaggactgcaggggcggtgcaagagaggagaggagacgtgcagagagccagagactgttggcgggtaggttataataggagaggagaggagacgtgcagtgactgtagatgggctaaaaaggcccaataactaaaccctagcgacgaccaggacacataagtcggacgactagtcgccctagtcgacgattagtcggacgaccagaacgactaggttgtctggtcgagtcgttcagcaaatcgtgtactaattaccgaccagcccgactaatcgcgattaatcgcgattagtcggacgacttgaaatatgatattttttgtggtgcttggcagattcagcagaaaggtttgaatcatcaaactatgatatttttttaaaagggcaatttactgccagtttacttacactgggaattatattagaaatgaagtatgcactttgttagctaaataagatgattgcgtaacagcatagttatttgacggtgaaaaaaagggcgtacccagtgccgtaggcttcccgcactgtgcggggtttggggaagggtatctttaagcgccaagccttacccgcataatatgcagaggctggggctcgaatccgggaccttccggttacagacggtaggctctaccgctgcaccaggcccgcataatagttatttgatggtgaaaccaatgaataatcagctatgttttagtcaaacacaaggccttagttaattagtgtcatagaggggaacaaacataatctggtcaagaaatgtttatattgttgagaggcctgcacatcatatttaattatgtatagagttgttgagtgcagtaacacatcttagccatccactgttccaggatttgttctgttggtgttctgttaggacatttaggacatctgtagtgtcagtttttatttaggtggccagaaggtttccttctaggaaagcacagtagtaatctcatgatacatttgaatctgaagttgggatttgggaatacatttctatgtgggtgatctgcacaattgtaccattaagagtactacatatattgtggcatcttatcttacatgtcttgcagtagagattgataagaaaacaccatgtactgcagaaagttgatcatcagttactgttttcaggttgctggtcaccaccaaaatgaagagttttctgtgagagggaaagaaccaaaggatgaagttcagatttacacatggaaggatgccactctccgtgagcttactgatcttgtgaaagaggttgctcttccagcaaggaaaaggaacgcgaggctttcttttgcatttgtatacccagacaagaatggtcgttttgttgtcagacaggtgggttcgaccttcgcttatggccatggaagaggtgatgatgccaaaactcttgcagagcttgggttccagattggcgattacctgagcgtcgcgatcatgtaagccggtgcccgcaatgagttccggcgactgcaccggatataactgatgtgatgtaaaaaatgcattggttgcgacgagcaagggatgagtatctgttagcgctaggaagtggaaccaaaactgtctgtaatgccggtactagcaaagttggctagacactttgaatgatcaaggcgtatggtatggtttcttgttggt

SEQ ID NO: 9568 - DNA, 1084 bp, Zea mays
tccgtgaccattcccgacggccttcccaaaagaaccggaaatttacaacccagtccaccacgggccacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccaactggcggcgtcgggcccgggactggcagagcggttcctcagggccttccggccggcgctgtacgaggtgctggcgtcgacggcgacgacgtgcgaggcggacggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtcggtaaaaaccaccaccccggtcccccaccccacccaccccccggcgagcggtgagcggtgaccccccgtcgcgcgcgcctcggctgtgtgctgcaagttccgtgtggccttccgtgtacgcgtagcaaaccaaagaagaagaaaaaaaaggtgtaggagcagtagtagtagtgcagggttgctgtcgcttgctttcccctttcgcttcttgtattccccctcccattctctttgcgttttccgttccgtgctgtcgcctgtagcgtgtaaatactccggttcgcacttggcagcagaggcagagtgtagagtgctcccgtggccgccgtggctgtggctgatggtgtagcactttttacgtgctcagctcgtgtagtagtacattgcatccttcttctattcaattctcccccgactggctaaaatatcgaggactgttttggaattggaacggttgtatgtgtgcgtgcagttgcatactgtaataataactccacagcaaaaattacagc

SEQ ID NO: 9569 - DNA, 2745 bp, Zea mays
acaaaatttcctccacccattctcttcctcctcttcttccccaccgactccaccgatccacatctttctatctgaatttcctctcgtcttgcccaccggtccatctgtctgttgcctctctctctctctccctctctcgcaaccaatcggttcttgtttcctccgtctgctgggttgattctctctctcttcctctccgtggagaggagaggatcgagaaacaggagacaggaaagaagagaaatcagaacggagcctgttcttttgcctggattgcggttctcgcgagttgttcagaaactctgggccagtttctggtcctttaaaatactggaacgaggaaccatcagagatgctaaggcaacagaccaattgatgttatctcgctaccctagtttggatcatcacaatgcaaggacagaggaattctgtggagcattttgctgatgtttttggattcgacattgcatctagttcaggcaaccctgtgatggatcagcagtcatattggaacaatgttcttggatcagtagaatcgcagaatcttcaaggttatcagatgaatcacagtgatgctgccatgccatatgggaatgagacacagcaagatggtacatttcttggtttctgggaatcaggcgaagcaagtgcaagtggcagctctaacaatgccaaaacagagcatcttagtattggcggtggtctgaggattggtgaaaggcgactggtagctgacaatggcatttctctggatgtggatatcaaccttaacgccaacgttaacgatctatgtggtcaaagttcaaatgttaactgtacatctcagggccctgagcactatggtggcggtgatcgtagtgttgtaaattctcagccaactgacctgagattacacccatacaggactttcctactagatgcagagcaagcagattcttttactttgaaccctagtgaaaaccctttgtgtgatttttcactgatgcaagaaagcattgaccaaagacccggtagttccctggatggacgccggctagcctgcaagagaaaaaatgttgaaggacccaatggccagagttcagcaggtgctagcactagtttttcccacaggaacgacaatgctttccataacattgcttcttcaagttacaatcctgcacctatcagaaatccgtcctcacccaattgcttgccggttccaagttctatcgatgatcaactcccacgatatggaactaatgcagggctctcagccggtacctatgaccttaatggaggggtcaacaatgctgggaattcgcagagaagtttccgggcaagaattactacgtctcaacagattgctccctgtagtgtatggccctcttcaaatgctatcagacttcctaattcatggaatcatcagccacctcattttcaaagtgcatttgatgatacccaggaggttattcctgtggtcagcagcctcaacttgcaataccagcatccagtgaatgtttctagtgtgccaccggctgcaaaccgtttcactggccatggagcttcatcatcgagagctggcagtttggagaacagaattcttggtagtcaagaggctcctacaaggaatgtggtgcctgccaactactctgatttagttcccccgtctgtagtagacccgagacgtttgctgccagaaccatctaattggagttctgatgtccgaggcactgcaatatcaggaagtattcctcctgtatcaagagctaataacagtgcaactgttaatccgccagcaggattcagtcaccaaaacctcacccggcgccatcctcgaaatttatcagaggagattggtcggctatctggagcacttcgcggccatcaacccccacgcttaaggccggggtttctgttggagcgccagggcgatggtgtttggggtgttcctttatcaacaaggggtagagaaggaagaaggttaatggagattcggaatgcacttgaaatgatccatagaggggagaatgtaaggcttgagtctatcttctatggcggtgttgacattcacgatagacacagggacatgcgccttgacattgacaatatgtcctatgaggagctattagcactcgaggaaagaataggaaatgtcggcactggcctcagcgaggaagctgtgataaggttgctcaaacaaaggaaattttcatcttggacactaaaagcatctttggaccctgaaccatgttgtatctgccaggaggagtacgctgatggagacgacctcgggaggctggactgcgggcacgacttccatgctggctgcatcaagcaatggctggtggtgaagaacgtgtgccccatctgcaagagcaccgcattgaagaagacctgaaacccgaacgaaggctcgtgtcagagacacccccccccccccccccccatgtttctatgttcactcgacggttcgcgagatcatttgccgattcgtattgctacgctttttttggtcgggaaaattttgccagccacctgcgattgggaaaggaaaagagagaaacagagagagagaggatgcggttgcggtcctctgtaaactgctgctgcagtaaataatccctggaatatgtcttccctgcattcaaccaaatatttagtagtagctgttatagtggacgtcgtaggattaaaaccttggaagagagcctgttggctgttgcccaccacttgccataattatgttcgatccggatttcaattttc

SEQ ID NO: 9570 - DNA, 3160 bp, Zea mays
ctctcctctcctctcctctccccgtcatttggctccgaaccctcacaactgtgcatcgtctctcctgtccccgccatttggttcggaactctcgcggcctcatctcctcctcgtcatcgtaacacccacgcttagagttcgtgagggtcgcccccaggggatctcgagacgtccgtttccaagagtggaccggctcggaggcgctgctgttaccttgggtggagctcggacctgcggatcagttggattctcaagggagacggtggtttctgatttcctttctctaagcataccaaatcctttgtctcgagtcgggagcaactggttttgggcgtcgcggacacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaataatgggcagtgcttgccaagctggcacagacgggccttcccgcaaggatgtgttagggatagggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagctttcaccaggtgcaaaacataatatcagtgtcattactaggttattaacataacagtaagttgcatgctaacccattatgatttctgcaaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgc

SEQ ID NO: 9571 - DNA, 2362 bp, Zea mays
cgaccgcgcgctgtggcaggcctacgtctcggccaacaagatcttcgcggacaaggtgctggaggtgatcaacccggacgacgacttcgtgtgggtgcacgactaccacctcatggtgctccccaccttcctgcgcaagcgcttcaaccgcatcaagctcggcttcttcctgcactcgccgttcccctcgtccgagatctacaagacgctccccgtgcgcgaggagcttctgcgcgccctgctcaactccgacctcatcggcttccacaccttcgactacgcgcgccacttcctctcctgctgcggccggatgctcgggctctcgtacgagtccaagcgggggcacatttgcctcgagtactacggccgtacggtgagcatcaagatcctgcctgtgggggtgcacatggagcagctcaagacggtgctcgggttgccggagaccgaggccaaggtgtccgagctgatggagatgtactctggaaaggggagagtggtcatgctgggcgtcgacgacatggacatcttcaaggggatcagcctcaagctgcttgccatggaggagctgctgcggcagcaccccgagtggcgggggaagctggtgctggtgcaggtcgccaacccggcgcgagggagggggaaggacgtcgccgaggtgcagaccgagacgtacgccatggtgcggcgcatcaacgaggcgtacggtgagccggggtacgagccggtggtcctgatcgatgagcctctgcagttctacgagcgcgtggcctactacgtcatagccgaggtgtgcctggtgaccgcggtcagggacggcatgaacctgattccctatgagtacatcgtctcccggcaggggaacgagaagctggacaggatgctgcggcaggggaagccagaggagaagaagagcatgctggtggtgtccgagttcatcggatgctcgccgtctctaagcggcgccatcagggtgaacccgtggaacatcgaggccgtggctgacgccatggagaccgcccttgtgctgcctgagaacgagaagaggctgcgccacgataagcacttccgctacgtgagcacccacgacgtcgggtactgggctaacagcttcctcctggaccttgagaggacctgcaagtatcattctcagaagaggtgctggggcattggcttcggcctgcggttcagagtggtctcgcttgacctgaccttcaggaagctttccttggagaacatccttatggcataccggagagccaagacacgggcaattctgctggactacgatggcacgctgatgccacaggcgattaacaagagcccgtccactgaatctgtgcggatcctcaacagcctgtgccgggacaaggacaatgtggtgtacctatgcagcgggtatgaccggcgcacccttcatgagtggttcccttgtgagaaccttggcatagccgcggagcatggctacttcctgaggtgtaagagggacgcggaatggaagacctgtgtcgctgccacagactgcagctggaagcagatcgcggagccggtgatgtgcctgtacagggagacgacggacggctcaaccatcgaggacagggagacggtgctcgtgtggaactacgaggacgcggaccccgacttcgggtcgtgccaggccaaggagctcgtcgaccaccttgagagcgtgctcgcgaacgagcctgtgtcggtgaagaccacgcctcactcagttgaagtgaaaccgcagggcgtgagcaagggcttggtggctcggcgcatgcttgtgtcgatgaaggagcggggccagtgcccggacttcgtcctgtgcatcggcgacgacaagtccgacgaggacatgttccagctgatcgccaccgctgcctgcggggactcgctggcgtccaaggcggaggtgttcgcgtgcaccgtcggccgcaagcccagcaaggccaagtactacctcgacgacgcggcggaggtggtgaggctgatgcaggggctctcctacgtctccgaggagctggcgctggcgaaccagcgggatgaagacgaggactcctctttggacgacgtgtgggaataggaaggagcgttcccttcccgtgctgctcctgcggtaatgtctgtttgtgttgttggctcggctggagctttcgccgagtagtttaggtgtgtaaatgaggtatgcttttcagcgtaatgtattgccagtggtctagtctcgagagctggcttgaatctagtgatgctctagtactttggtttgtggtgctatttacctgatccgtggaaggcagtactatgagctatacaagatgcagacctgaaatctcattcatctgaagaccatgacctttctcct

SEQ ID NO: 9572 - DNA, 1837 bp, Zea mays
gtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttcgagtt

SEQ ID NO: 9573 - DNA, 1131 bp, Zea mays
cggagatcttcttctcgcagatcccggacttcgaccagatctcctggctctccatcctcgccgccgtcatgtccttcacctactcctccattgggctcggcctgggcgtcgtccaagtcatcgcgaacagaggcgtgcagggcagcctgaccggcatcaccatcggcgtggtgaccccgatggacaaggtgtggcgcagcctccaggcgttcggcgacgtcgccttcgcctactcctactccctcatcctgatcgagatccaggacaccatccgggcgccgccgccgtcggagtcgacggtgatgaagcgcgccacggtggtgagcgtggcggtcaccacgctcttctacatgctgtgcggctgcatggggtacgcggcgttcggcgacggcgcgcccgggaacctcctcacgggcttcggcttctacgagcccttctggctcctggacgtggccaacgccgccatcgtggtccacctggtcggcgcctaccaggtctactgccagccgctgttcgccttcgtggagaagtgggccgcgcagcggtggccggactcggcgtacatcaccggggaggtcgaggtcccgctcccgctcccggcgagccggcggcggtgctgcaaggtgaacctgttccgggcgacgtggcggacggcgttcgtcgtggccacgacggtcgtgtccatgctgctgcccttcttcaacgacgtggtgggcttcctgggcgcgctcggcttctggccgctcaccgtctacttccccgtcgagatgtacgtggtgcagaagaaggtgccgcggtggagctcccggtgggtgtgcctgcagatgctcagcctcggctgcctcgtcatctccatcgccgccgcagccgggtccatcgccggcatcgcgtccgacctcaaagtctaccgcccgttcaagtcctactgatcagattcacggcctacgggagacgcagcagcatgtggtatataggcatatactagcaaccatgttcgtgtgagttgcaactcataagtacttaaatcagactctgcatcattgctaaacgtgagtttgtctaacttgtataagcatgattaatgagtcccaattacatatgagaaggacgcaacacaatatatattgaaat

SEQ ID NO: 9574 - DNA, 844 bp, Zea mays
gcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatccccacgcacgccgtcgccgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcaacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttccaagtttgtttacgcatggatttcttggcccc

SEQ ID NO: 9575 - DNA, 1091 bp, Zea mays
cagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcggggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaatgtctcctccatcgccagcgtccttggcttcccgcaggaagtcatgtacagcgtcaccaaaggaggactgaatcagatgacgaggagcctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatatatagcgaagaataaatgtggatctattctctattctactgtatttgaatttgttttcgttcttgtcttcttgatcggccatgtatcaccgtcagacgtcagcggcaataatccggccgccgtcggcttgccgggagggagatacccaactagcgacatgcaagctgcccgatcagtcgtctcgtctcgcctcgccggccggcaaggtgcagccactgtcgttgcctgcagttctgttcctttttctactatggtttcttgtattcactgcccactggtgatgtttctgtgataacgacttcgacagaggggatacatttt

SEQ ID NO: 9576 - DNA, 2137 bp, Zea mays
agtagcccattttcctggaggcggcgacggcagcggcccagcccacctctgccgctgtgcttcgcgtgggccgtgcaactcgccggagacggaagcgacgtcggcgagaaccgcgctgccgttgccgtcgaggcgatatggccctaccctcgtcgacggagacacggagtccgcatccgcctccgcctccggggcgctcgtcgtggtcggcgccgcgtgatcccacgggggtctagaatccgggcctcgtcttcatcacccgccacccaccggcgtccgcaagatgcgcgagatggcaccgccgccacaagcctctcatccggattggattggttccggctgttgcttgctccaggaagaacactggacatggacttcttcacggaatatggggaggcgagtcagtatcaaatccaagaggtcattggtaagggaagttatggagtagttgctgctgcaattgatagtcacactggggagcgggttgcgatcaagaagataaatgatatttttggtaatgtctcggatgctgctcgcattttgcgggaaatcaagcttcttcgtctgcttcgtcacccaaacatagtccagattaagcacattatgttgccccctacccgaagggagttcaaagatatctatgttgtttttgagctcatggagtctgacctgcatcaagtgatcaaagcaaatgataacctgactccagagcatcaccgctttttcctgtatcaacttatttgtgctctcaagtacatgcattcagcccatgtatttcatcgtgatttaaagcccaggaacatactggccaattcagacagcaaactaaagatctgcgactttggacttgcacgtgcatcatttaacgactctctttcagctatctattggacagattatgtcgcaacaaggtggtaccgggctcctgaattatgtggctcctttttctccagttacacccctgcaattgatatttggagtatagggtgcatttttgctgaagttctcaccggaacaccattgtttcctgggaggaatgttgtgcaccaattagacttaataacagatctccttggaacaccatcgtttagatccttatcccagattcacagtgataaggccagggaatatttgcttggcatgccgaggaagcgccctattccattttctcataagttccataatgccgatcctctggctctacggttgctagagcgtttacttgcatttgacccgaaagatcgacctactgctgaagaggctttagctgatccatacttcagtggcctttctaaattggaacttgagccttcagcacaaccaatttcgaaggttgactttgaattcgagggaaggaaactaacaaaggctggtgtgagagaaatgatatatcgggagattttggagtaccacccccagatgcttcaggagtacatcgaaggtggagatcagattcacttcctatacccaagtggggtcgatcgcttccagcgacagtttgctcatctcgaggagaactacaggagaggagtagcaagcaccccgccgcgaaggcagcccacatctctgccgagagagcgagtctgctcatcagaagatggccacagtcaggactctgacagcgaagagcaaagagcagcatcctacgttgcccgaacaaccataagccctccaagatcacaagaggagggcggcaagctccagcctgcctaccagagcgccgccgccgccgcagactcctgcgccaagagctatctgaagggtgccgctagtatcagtagtgcttccaggcgtaccatcaagggggataatggccgaaaggagaaggaatctccgaggctgtgaaagaggtggcgcaggctcgtgacctgttaggcaaaagaggtagcaatggcgccaatgcgactgcaacgtgggatgtcttagtcatcatgcatccaacaacgcaggggggcagtacaagtatgcaggtcatcctagctaggtcgcccaaattaaagcagcctgcttggaggaattagatttgtgtactgttgttaagtttttttttttttgaattcaactgctagattctggcagatctgtcaaccgcactctccttggtttcccaaaatttactggtttgaacaagtttatt

SEQ ID NO: 9577 - DNA, 943 bp, Zea mays
cgaccgtcacctgcttcaccaccggcgagccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagtttcctgtacttgtggggtgaatttgtacgtgtgatacggtaacttggtccgtgtactgtttatgctgctacgttttccttcctaaaagtacgtatatatatacagcacttgcgagtggctttacttgtgtgcactgcctaaaagtgtcgatattacctccagcggtaaataaatgacccttgtaagaaactt

SEQ ID NO: 9578 - DNA, 1767 bp, Zea mays
gtcgatactcaatgatggccatggaaagtttgcaaaaggaaaattttgaccatggaaagaggaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacagtacaaagcaacacttgatctccaactcttaggccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttacgtatcagaaagtgctctggaggacagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagcaaaactatcgccatggaaaatatgcattctgtatgcaatgaccccatggattaaagcttcagtaataagtaagatggtcacatctatat

SEQ ID NO: 9579 - DNA, 1799 bp, Zea mays
gtcttcatttctctctctcctctcatctccacctctcctccggctagggtgtacacgcctgccgcggcgaagcttctgtcccccctccccccggcgtcgcgctctggtcgtcgtcggccgggaagatggctggcggcttcagggtactgcatctggtcaggccctttctggctttcttgccagaggtgcagagcgcggataggaagataccattcagagaaaaagttatctacactgttatttctctcttcatttttctggtgtgcagccagcttccactctatggcattcattcgacgactggagctgatcctttctactggatgcgtgttatccttgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggtagtgtaagccaacttggaacagggaatgctattctcattatacttcagcttttctttgctggcatcattgtcatctgtttggatgaacttctccagaaaggttatggtttgggatctggtatttctctgttcattgctaccaatatctgtgagaatatcatctggaaggcatttagccccacaaccatcaacagtggtcgtggcgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcatccttcactctgcgctgattaccaacctctattttatatcccagcttctctacaggaagtacagtggaaacttccttgttaaccttcttgggaagtggaaggagtctgaatactctggccattctattcctgttggtggtcttgcttactatgtaactgccccatcaagtttggctgatgtccttgcaaatccattccatgcactgttttatgtggtcttcatgctgtcagcctgtgctctgttctcaaagacatggattgaagtttcgggttcatcagcaaaggatgttgctaagcagctcaaggaacaacaaatggtgatgccaggccatcgtgagtcgaacttgcagaaggaacttaaccgatacatccccactgctgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgtagtgcttagccagttgtaacttaaagagttctgtttaggttgccttcttgcggccacaatcatgtagcagaatgtgcgtgtgtttcaggttagcgtgggggtatgtgcatctgtccaaagagtctgcaatttggcaaccggatattttgttatcaatttcagttacttcgaactgagcatgttctcattc

SEQ ID NO: 9580 - DNA, 822 bp, Zea mays
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgttatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 9581 - DNA, 1275 bp, Zea mays
cgcccaatgcgtagttgtatctgcatctccaacaccaccagcagaggttccagttagtttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggccccgaggccggcgtgtccgagaagacgtccggcgcgtctgacgacggcggcaggctccgtggagccggcgggaacgccttcccgtggagcaatgcgatgctgcagtggcagcgcacgggattccacttccagccgcagaagaactggatgaacgaccccaatggccccgtgtactacaagggctggtaccacctcttctaccagtacaaccctgacggcgccatctggggcaacaagatcgcgtggggccacgccgtgtcccgcgacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccaaggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcccgggcctgctccaccgcgtcgacggcaccggcatgtgggagtgcatcgacttctaccccgtcgccacacgaggcagggcgtcggccaacggcgtcgacatgtccgacgccatcgccagcaacggcgccgtcgccggggacgtcctgcacgtcatgaaggccagcatggacgacgaccgccacgactactacgcgctggggaggtacgac

SEQ ID NO: 9582 - DNA, 2048 bp, Zea mays
caaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccattctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttcgagtt

SEQ ID NO: 9583 - DNA, 1270 bp, Zea mays
tggctgtcgtcggcgtcgcgctcctcgctcggcgccgccgtcggcggggaggccaaggtcacgccggaggcggatccggcggcgcagcccgacgacgccgacgaggagcgctggtcgcgcctgctgccggagctgctcacggagatcatgcggcgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaaattcaaccttttctctctatctcagcttaacgcaggccctaacggataaagggaagtttcttttggctgctcgaaggttcagacaaggagcacatacagaatatatcatctcttatgactatgatgatctgcacccaagaagcagttcatatgttggaaagttaagatctgacttcttggggacaaagttcatcatctatgatagccaggcgccatatgacggtgccaaaccttcgaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccacccaaggagaaaacaccctcgccgagttccttggacctaaagaacaaggctccaagatggcacgaccatcttcagtgttggtgcttaaatttccacggccgggtgaccgtcgcctccgtgaagaacttccagctcgtcgccacagctggctccggcggtccatggggcgtcggagacgaggagacggtgatcctgcagttcgggaagatcgaggacgatgcgtttacgatggactaccggcagcctctgtccgccttccaggcgttcgccatctgcctgaccagctttggcacgaagctggcctgtgaataaatggttgccggtttaccaactatgttggggatcagattgtagggggtagtctgaactagttgccctgagcacctcagatgggagaaactggcgataagaaacagggcggacgttgtccctataagctttgactccttgtaatcgcctaaatgattgatttatatatatatgatgtgcgcctatgttgttgaag

SEQ ID NO: 9584 - DNA, 3628 bp, Zea mays
cttctcgactccatagcgcaccacaccagcgcggcgacagccagcccgcgaggagaaaaactagaagaggaggaacagggagagccatacatactcactggttggattcggtccaatccaatccagccggccgcggcgtgaccagccgatccagagggcgccgaatcgatctgcgggggcggcgcggcgatgcggagggctaccgctggggagcccggtcgccgcgggggatgcgcatgagggcgtccggcccgcgaatcttctggtttggcgggagcccagggggcgcgcaccccggatcggcggcgcgcggcgagggcaggatcgcgtcggtggggctgcggcagtgaccacgggcgcgggggagggtgagaagcggcaactagcacttcggaggcgagcgggcgcgatggtgagcggccacatcttccactgccggaagaactcgtggccggcggaggagtacgtcggccggaccgcgctgcagctgttggatttcgatggcggggcgccgccggagcaggcgtggcggaggcggctcaacagccacgcgaacatcctcaaggagttcagtgtcactttcatggaggcaatgaggatgatgagccttggcctgagactatggtcgtatgttcgggaggaggcgtcacatggacggaaagcaccgatcgatccgttcactaaagagcgctgtaaaccgtcagcttcccagggtgtgccacttggtgggatggggagcggaagcatttcaagaggtttcaggggagagttcaagaattggcacatcatacctggtctttgtgaaagttcgccggtcatggagaaccagttctctatatttgtatctcgagacgggggtaataagaaatactcatcagttttggctcctggacatcatgaaggtctgaagaaaaatagtgactctggaatttcttcatgggactggaatttaagtggtcaacactcgacctatcatgcattgttccctcgggcatggactgtttatgatggtgaacctgatccagaccttaaaatctcatgtcgtcagatatcacctttcattcctcatgattacaaggatagcagtcttccaacatctgtgtttgtgtatactctagtaaacaccgggagagatcgtgcaaaagtaagcctgttaatgacatgggcgaattctattggaggtttttcgcataattcaggaggccactacaatgagcccttcattgcggaagatggagtatcaggagtgcttctgcatcacaaaacagccaaggataatccacctgtcacttttgctgttgctgcctgcgaaactcagaatgtgaatgtgacagtcttgccagtgtttggtctttctggagaaaaccatgtttccgcaaaggaaatgtggaacaccatgctacagaatggtcactttgatcgggaaaatttcagtgctggtcccagtatgccttcttctccaggacagaaactctgtgcagctgtctcagcctcaacttgggttgagccacatggtagatgtactgttgtgtttgctctggcttggtcctcacctaaagtaaagtttcaaaaaggatgcacatataacaggaggtacacccaattctacggaacttctgagaaatcggctgttaatttggtacatgatgccttaacaaaatataaactttgggaagaagaaattgagaagtggcaaaaccccatactgaaggatgaaaggcttccagaatggtataagttcactctttttaatgagctttactttctggtagctggggggactgtttggacagatggtcaacccccagcaatcgatgagaaaaagagtcctggttttaatcaccagaagtcctcaaagaggggtactaaagacacaaatcagggatctgttaaagatagacatgtcaacctggcagtggagcaagtacctcatggtggttacatggctaatggtgatgatcatagtgtatccaagttcgcagcagttcatggatcagaattgcaagaacaaaccaatggactcaagtcagaagagccaattccttacttgatttcaaaggatggccctgaacacgttggcaagtttttgtatctagaaggagtggaatacatcatgtggaacacatatgatgtgcatttctacgcatcttttgctctccttgatttgttcccaaaaatagagttgagtatccaacgtgattttgccaatgctgtgctgtatgaagatcggcgcaaagtaaaatttttggctgatggtacatccggaatccgcaaggctaaaggtgcagtgcctcatgacctcggaacgcatgatccgtggcatgaaatgaatgcatataacatacacgatacaagcaaatggaaagatttgaaccccaaatttgtgctccagatatacagagactttgctgctacaggtgatatgcaattcggtcgagatgtttggcctgcagtctgtgctgctatggactatatggatcagtttgaccgtgatggtgatggtctgattgagaatgatggatttcctgatcaaacctatgatgcttggactgttcatggaatcagtgcttactgtggttgtctttggcttgctgcacttcaagctgcagctacaatggctcatcgccttggggatcggcactttgctgagaagtacaagctaaagtttataaaagccaaagcagtatatgaggcgaagttatggaatgggtcatatttcaattacgacagcggcacaagtagcaatagtagatccattcaggccgatcagctggcaggacagtggtatgctgcctcgtcgggcttgcccccgcttttcgatgagcacaagataagaactgctctgcaaaaaatatttgaattcaatgtgatgaaggttaaaggaggacggatgggagctgtaaatggtatgactccaaagggaaaggtggacgagacatgcatgcaatcacgtgaaatctggactggtgttacatacgctgttgctgcaaatatgctgctccatggaatggagcatcaaggctttacgaccgcagaaggaatttttactgcgggatggtcagaagaaggatatgggtattggttccaaacaccagaaggatggaccacagatgggcattatagatccctcgtatacatgcggcctcttgccatttgggcgatccagtatgcagtttctcctcccaaggctattctcgaggcccccaaagttaacctaatggaccgaatacatatctcccctcacatggtccgagcaattagcgagataagcattagaaaggtagcacccgacaatagatgtttgcctagctctgcctttcactgtgaatgctgatccgaaggtaaacatgcagctgctgagcaacttgcaaccttattcggcttttttcggtttctctccttgcccccctttcaaaggtccaggtgggggctcaggagttcttttcttggatcagagggcatatccaaaccaccaccaaactcgtgactcaagagagttcatgttgtataattgtacagcaaactgttagtcacataatcttttttttttcactttgaaagttttgtgctgttcacttggaatagagctagaaataaaagaactgggaagctagctggtgtctacact

SEQ ID NO: 9585 - DNA, 2028 bp, Zea mays
cccgcacccaacccaaccacggacgcacgccgaggagggagaaagcgggtgtggaggggcggccggccggcctcgcatgtttgacgacgcgggggccgtggcggtgaagcggatgaggctgtgggaggaggacgaggtggaagtggaggaggaggggatggaggtggacgcggagccgggatggccgtggggaacgccggcggcggggctctccagggcggcggcgatcgtcgtggcggacgcggcggatcccgacttccccgtcatatacgtcaacgccgcattcgagtccgccacggggtaccgcgcccacgaggtgctcgggcgcaactgccgattcctgcaatttcgggatccacgagcccagaggcgacatccccttgttgatcccatggtcgtttcagagatccggcgatgcctcaacgaggggattgaattccaaggcgagctgctaaatttccgaaaggatggcgctccactttacaacagattaagtctcattccaatgcacggggatgatggctacgtgacacatgtgattggaatccaactattctccgaggcaaacatcgatctcagcagcgtgtcgtatccggtgtacaagcaacagaccaacaacaggcccatcattcaagatctgaactcagcttcccatgagcatgctccgaaagtccagagtgcagaccactgcggtatgcttcagttgtcagacgaagttctcgcacacaacattctgtctcgcctgtcacctagagatgtcgcatccattggatccgtctgtaccaggatgcatgagcttaccaagaatgatcacctgaggaagatggtctgccagaacgcgtggggaagggatgccactgtcaagcttgagatgagcaccaagatggtaggatggggccgtcttgcgagagagctaactactcttgaggccgcctcgtggaggaagttcacggttggagggcgcgtcgagccttcccgatgcaacttcagtgcctgtgctgttggtaaccgcttggtccttttcggaggggagggtgtcaacatgcagcctatggacgacacctttgtgcttaacatggaggctgcaaggccggaatggcgccgcgtgaaggtttccgcctccccaccaggccggtgggggcacactctgtcgtggctgaacgggtcatggctggtggtatttgggggctgcggacagcaaggtttgctcaatgatgtcttcgtccttgaccttgacgctcagcagccaacgtggagggaggttgcaagcgagggtcctccactgccacggtcctggcacagctcatgcaccttggatggttcgaagctggtcgtctccggtggctgcaccgagtctggcgttctcctcagcgacaccttcctgcttgacctcaccaaggagaagcctgcgtggagggaaattcccacatcttggtcacccccatcccgcctcggccacaccatgtccgtctacggtacgactaaactgctcatgttcggtgggctggcgaagagcggctcgctccggctgcgctccagcgacgcctacacgatggacgtcggcgaagatagtccgcagtggaggcagctggcgacgaccggattcccaaacgtcggcccaccgccgaggctcgatcacgttgcggtgagcctgccctgtggacggatcatcatattcggtggctccatcgcgggactccactccccggcgcagctgttcctggtcgatccagcagaggagaagccgacgtggaggatcctgaatgttcccggcaaaccccccaagttcgcctgggggcacagcacctgcgtggttggcggcactagggtcctcgtcctcggaggccacaccggggaggagtggatactgaacgagctacatgagctctgcctggcaagcaggcccgacgacgacgacgatgaccgctactgactagtttcgttgcacatggtgttttatatgcttcgtaactacatccagtctgttgttgggtaatcggtatgacaaaaaatagcggaaaattaatt

SEQ ID NO: 9586 - DNA, 2686 bp, Zea mays
cgaatcactacagtcgagctcgagcaggaacaatccttgagcgcctgcccccccggtcctcagtatctattccacacctcatggcgccggcgctgagcaggaccctgggcccgtcgtcggtggccgcgctgcgcccgagcccgtcgtgccggggtctgctacgggccgcgctagtgccgcagggcaggggcgcctccgcgaggtgcgcggtaggggtgagatgggaggcagccaggcggaggaggatggccggggtgaggtgcgacgccgccgtcgctgagaagcctgccggcgaggaggagacggccggcgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgatccttctgtgttggctgatggtggtgagttggagataaggattaaacccgacctagaggcggggacaatcactatcacagatactggcattggaatgactaaagatgagctcaaagactgtcttggaaccattgcacaaagtggcacctcaaaatttttgaaggctctaaaggagaacaaagatcttggtgcagataatggactcattggtcaatttggtgtcgggttctattccgctttccttgttgcagagagggttgtggtgtctactaaaagtccaaaggcagataagcagtatgtgtgggaagcagaggctgacagcagctcgtatgttatcaaggaagaaaatgatcctgagaaaatgctttcacgtggaacagagattactctttatttgagagatgatgacaaatatgagtttgctgaccctaccaggattcaaggcttagttaagaactactcgcagtttgtctcattccccatatatacatggcaggaaaaatcaagaacagttgaggttgaagaggaggaagaatcaaaaggtgaagaggctactgaagaatcaaaaagtgaagaggctactgagggtgaaaagcagaaaaagaagaaaaccataaccgagaagtactgggactgggaattggctaatgaaacgaagcccatatggatgaggaatccaaaggaagttgagaaaactgagtacaatgaattctacaagaagacatttaatgagtttctggatccgcttgcttacactcacttcaccactgagggagaggtggaatttcggagtgttctctatgtcccagggatggcgcctcttagtaatgaggagataatgaatccaaagaccaaaaacatccgattgtatgtcaaaagagtgttcatatcagatgattttgatggcgagctgtttcccagatacttgagctttgtgaaaggtgtagttgactcaaatgatctccctctcaatgtttctcgtgagatccttcaagaaagtagaattgtcagaattatgcgtaagagacttgttaggaaggcatttgacatgattcaagagattgccgagaaggatggcaaagaggactacaacaaattctgggagagttttggcaagttcatgaagcttggttgcatcgaggacacaggaaaccacaagcgtcttgcaccattgctgagattctactcttccaaaaatgagacagatttaataagtctggatcagtatgtagaaaacatgcctgaaaaccagaaggcgatctattatatcgctactgatagtctccagagcgcgaagactgctcctttcttggaaaagctggttcagaaagatattgaggttctttacctcattgagccaattgatgaggttgccattcagaatttacagacatacaaagagaagaagttcgttgatattagcaaagaggatttggaattgggtgatgaagatgaggacaaggagaaagaaagcaagcaggagtatactcttctatgcgactggataaagcagcagcttggcgataaagtcgccaaggtgcagatctcgaagcgactcagctcttctccatgcgttcttgtttctggtaaatttggctggtcagccaacatggaaaggctcatgaaggcacagacccttggtgacacatcaagcctggagttcatgagaggtagacgaatttttgagatcaaccccgaccatcctatcatcaaggacctgaacgctgcttgcaaaagcgagcctgaaagtactgaagccaagagggcggctgagttgctatacgaggctgcgctgatctccagtgggtatactcctgacagtccagcggagctgggaggcaagatctacgagatgatgaccatggccctcggcgggagatgggggaggttggagacagaggaggctgaagtcatcgccagcatcgacgacgcggactcgtctgaaggtgccacgaccacgacagaggtagtcgagccctctgaggtcaggacagagagcgacccgtggaaggattagatagttctgtatgcaaggattatgccctggtgtggtgtatgagcactggatgtaacgaaagtacgaaccagagccaggatagaggaatgcagcgtttgataagaacactggtgttaaaagtgtagatctctggtttgggttgtgctgataaatttttgtaggctataaccatccaatgaaaaatgccctctgcgctttcgtgcattctttct

SEQ ID NO: 9587 - DNA, 1559 bp, Zea mays
tgttaacttcaccgcattgagggaaattaaactacttaaggagctgaaaggtcctaatattatagagctgattgattgtttcccttacaaggaaaatttgcaccttgtatttgagtttatggaaactgatctggaagctctcataaaagataagaacataatactgtctccagctgacacaaaatcatatctccagatgctgttaaaaggtctatcgttctgtcataagaaatgggtgatacacagggatatgaagccaaataatttactcattggtgccgatgggcagctcaagcttgctgactttggtctggcccgaatgtttgggagtccaggaaggaacttcactcaccaggtctttgcacgttggtaccgggcaccagaattattatttggttcgaagcagtatggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtttatcttcctgattatgttgaataccaatatgttgctgcaccaccgctacgtacattgcttccgatggccagtgatgatgctttggatcttttgtcaaaaatgcttacgtatgatccaaaagcaagaatcagtgctcagcaggctctagagcacaggtacttttcatcgttacctgctccaacaagaccatcacagcttctaaggtcacggtggaaaggagatcaagggaataacaagatgcccgatctgaacctgcagcatggccctctggtgctctctccgccaagaaagctacgtagggtgatagcgcatgaatggatggaaggtatgcacagggcagataaagtggacgagcatccttctgggatgaggcacaccgatgacatgcccagtcagaagagttctagaattccaatgtcagttgatgttggagctgtgtttggcacacgacctgcacctaggccaacattgaacagtgcggacaagtctcgtttaaaacggaaacttgatatggatccagagtttggatttgcggagtaaaagaaactttgttaacatgcaccattcttttcttactgagatgttggtttcgaaaatattctttgggagatatttccacagttcactcagaaaagaggatttgcattgaagccacaaaactgcaccgaaggattctgacacaatcaactgggctgttaccgacatcggctcacgaagaggaaaacaaaggagaggccattctaatttatcctgagtcgcatggggcattatagctaaccgattccgtaaagaaggctcttagaaacagcatgctctatgccatgcgagtggagagtgttatgtggaattgggggcatagaaacgctcgctccagttagaaatgtgtgtttgtgctaaatgtgatctactagtcctccattctccgtggtttcaatttccttcaattcttgtacggacacttaggtttgagcattcttcactcagtcactttacgtat

SEQ ID NO: 9588 - DNA, 881 bp, Zea mays
cctgaaaacctcacaaaaccctcgctcgctccccaccacaccgccgcgccgccgcctgtaccagctacgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggcggcatgggtgatatgggtggtcttggtggcatgggtggtatgggtggtcttggtggcatgggcggtatgggaatggatgatttcgaagatgagagtgatgatgaagaagaagtgtcgaaacctcaagctgcggacaaggctgttgaggctgaggagacggagtcagcggaaaccaagactgaggcggctcagagcagttgaagatgcttatgatctaagctagattgtatcctcatgtttaattctgctgaatcggaggacaaaccttacatttgtggtgctggcaagtcccagtggcgtgccatgaaaatttacgttccgtcttttaactgggtatccgagtgtgtgctcagcatattatggatattgtttccgtaatgcttcctttggtcgccaatcatgtgaagagtttgtttt

SEQ ID NO: 9589 - DNA, 1833 bp, Zea mays
gtttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagc

SEQ ID NO: 9590 - DNA, 1827 bp, Zea mays
ctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgccgtggtctgcggatacggtgatgtcggcaagggttgtgccgctgcactcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 9591 - DNA, 1791 bp, Zea mays
cccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgccgtggtctgcggatacggtgatgtcggcaagggttgtgccgctgcactcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgttt

SEQ ID NO: 9592 - DNA, 1825 bp, Zea mays
cactccagcactgaacacttgattgattcagtaggtagctaggtagctgaatcacaaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgcgtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcggcccggggctggtggtgccagggatctactactccgacgacaagatgctgcagtgccgggtgttcgcctacgccgacacgcagcgctacaggctggggccaaactacctgatgctgcccgtcaacgcgccgcgctgcgcgcaccacaacaaccactacgacggcgccatgaacttcatgcaccgggacgaggaggtggactactacccgtccaggcacgcgccgctgcggcaggcggcgccgcccacgccactgccgccaaggccggtcgccgggaggagggagaaggccaccatacgcaagcccaacgacttcaagcagccaggggagaggtaccggtcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctcaataataatgaagacgcatgcatgtcgtcgccaggaacaagagaaataatacaagaccagcacgcatgcatgggcatactctatatatatgtatagcccgtgcccgtgtccgcctttgtaccaatacaagccaaaccaagtggatgtgtattattattattattattgcgttatcacatacatgtacccctgctacctgaagatggatgtgtatcgagttatcaaattaaggcaccagcagcaaaaactatatatgttgcataag

SEQ ID NO: 9593 - DNA, 3312 bp, Zea mays
ctctagtctcaccgccccgtcccgctcattggacgagacgacggacccttcccttctcgcacgggaagagtagcgaggaggcgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaagatcctcaagttccttgggttcatgtggaacccgctgtcgtgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttcttagagatggccgatggggcgagcaagaggctgcaatcttggttcctggtgacatcatcagcatcaagcttggcgatatcgtccctgccgacgctcgtctcctcgagggtgacgctctcaaggttgaccagtctgcgcttactggagaatccctcccggttaccaagggccctggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctcgattggggtcggcatcctcgtcgagatcatcgtcatgttcccaatccagcaccgcaagtaccgcagcggaatcgagaacctgttggtcctcttgatcggtggtatcccaatcgccatgcccactgtgctttcagttaccatggccattggttcgcacaagctgtcacagcagggtgccatcactaagaggatgactgccattgaggagatggctggtatggacgtgctttgcagtgacaagaccggcacactcaccctcaacaagcttagcgtcgacaagaacctcgtcgaggtgttctgcaaaggcgtcgacaaagaccatgtgttgctgttggctgcaagggcttcaaggactgagaaccaggacgccatcgatgccgccatggttggcatgcttgctgatcctaaggaggccagggctggtatcagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagtcccctggtggaccatggcagttcgttggtctgttgcccctgtttgatccgcctaggcatgacagtgctgagacaattcgcaaggctcttgttcttggtgttaacgtcaagatgatcacgggtgatcagcttgctattggtaaggagactggaaggaggcttggcatgggtaccaacatgtatccttcctctgcgctgctcggccaaaacaaggatgctacgcttgaagcgcttcctgtagatgagctcattgagaaggccgatggttttgccggagtcttccctgaacacaagtacgagattgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgcttggatttatgctcattgcgttgatctggcaatacgatttctctcccttcatggttcttatcattgccattctcaatgacggtactatcatgaccatctctaaggatagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtgagtatcgtgagccaggctctgatcttcgtcacccgttcccgtagctggtccttcgtggagcgccctggtctgctccttgtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggtcacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctataccaccagatactgccatatgatggtatggttgggtacccgtctttctagggagtttcttttctctctctcttttttcttattgttatgtttttcaatagtggagtgtgcgcgtgttgtaatcgtttttacctgcgtttttctctaactagccggtgacctcgcgggaagcgaggtgaagaaataatgcaactaaaattctctgcc

SEQ ID NO: 9594 - DNA, 646 bp, Zea mays; identical to SEQ ID NO: 1180

SEQ ID NO: 9595 - DNA, 1103 bp, Zea mays
gcagttccccgaccacaccgttcctccgagcccaggagcagccccgcgccaggaggaagtttgttcttttaacaatatgtcgagggaggagaatgtttacatggccaagttggctgagcaggctgaaaggtacgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcaggcgagggacagtaatcttcggagggggtgcaaagttgttcgagccccaatgttttagatgctctatgctgtcgaagctgtgctgtgctattattgtagctgatttcgtctccattcacttcttttttcttgttagtaggctggtagtggtcgaattagtaccccattgctttgtgttgccgctagtccatgtggactggtattgttcccctggatttatttggcaagcgtgtccgtgctcgctctagcgttttattgagcttttaaagtc

SEQ ID NO: 9596 - DNA, 1273 bp, Zea mays
ggtgaagccgccgccgccgccgccgccgctgcagtgtccatagccaccgcagcagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaatctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgatgacgaggatgacgagtaaagtttcgtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcgaacaaagttgtttattttagtttgggcacacaagattagagagctagcgagaaactatggcatactcgatcggttaggaataatgtcaattgaagaaaagtttatttaacacc

SEQ ID NO: 9597 - DNA, 827 bp, Zea mays
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcgggtacggtggtggccgtggaggcggcggctacggcggtggcggtcgccgtgatggcggcggcggctacggcggtggcggcggcggctacggtggcggcggcggctacggtggtggtggcggcggctacggcggtggcaaccgtggcggcggctacggcaactccgatgggaactggaggaactgagcggtggggcccgcgcggccaagttatcctgttcgctgccgtgttgtttgccctagtccacagggtttatcttcgttcgtgtcgtgtttgttgttgcccatctgtgtttttgattgcaaggtcgctctgtgtcagttgttagtgctgtgttcatcctcggcttcaacagacccatgcatcaaacagcatggactgcggatcgatggatgctgttacccccgtcagactttattctaagttaatcttaaggaaaaaatggtgcttcttggtgctgc

SEQ ID NO: 9598 - DNA, 1431 bp, Zea mays
caagaatccttgagcttgctgaagagctgtctatgccacttgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaatcgtgtccgagctctccaacaaggatttcgactcatatgtcctctctgagtcaagcttgtttatctatcctctgaagattgtcatcaagacctgtggcactaccaagctcctgctcaccattccaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttacgaggttatgggcttggatgccactgctctgtcttatggtgaccttgtcaagagggtcctccggtgctttggcccctcggagttttccgttgccgtgaccatctttggtgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctctgctgggaggaggaagcggatgccatggaggagaagggcgggagtgcttgatgagaaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttcgagtt

SEQ ID NO: 9599 - DNA, 1472 bp, Zea mays
gctaacaaaatcttgaaccccctgaaccctccacattcctccagatcgaataataacctggctctgcacaccgcgcagccaccagtggcagcaggagcaggggttggaacaagatggtggggacggcggccggcagcgcggaggaggctgtgcggcggtgggtggacgccgccggagggcgcctcgtcctcgacggcgggctggccacggagctcgaggccaacggcgccaacctcaacgacccgctctggagcgctaagtgcctcctctcctccccgcacctcatccgcaaggtccacatggactatctggaagctggcgcaaacattataatcacagcatcgtatcaggccactattcaagggtttgaatcaaagggtttttcaaaagaacagagtgaaaagttactaacaaagagtgtcgagattgcactggaagctcgtgagatgttcttgaaggaacatctggagaagtccactcctatacagcacccggttctggtcgcagcgtctttagggagttatggagcttatcttgccgatggctccgagtacagtggggattatggtgaagctggtacgaaagagttcctgaaagatttccatcggcggaggctccaggttcttgcggaagcaggccccgatttgattgctttcgaaacgattcccaacaaactggaagctgaggcatatgtcgaacttctcgaggagtgcaacatcaatatccctgcatggttttccttcaactcaaaagatggagtgcatattgtgagcggcgactcgttaatcgaatgcgctactattgctgacaagtgtgcaaaggttggtgcggtcgggataaactgcacacctccaagatttattcatggactgatactctccattcgaaaggtcacggacaagccgattctgatatatcccaacagtggcgaaagatacgatggtgaaaaaaaggagtgggtggaatccactggtgtgtcagatggtgattttgtttcttatgtgaacgagtggtgcaaagacggggctgtgcttatcggtggctgctgcaggacaactccaaacactatcagggccatacacagaactctgaacaaaagccccaacaagcagcagttacctgctgtagaatagagctgtgctctactcctgatgcgcccggccttcctcccagcagtacctcgaggctgtaaccccatgattccttaaccgtacgtgttcgttgtcttgcaaacgagatgtttgtaaataacgctgtatttctgggttctgagatatgcaacttggatggaggtacaaccggtgaaggggggtgaggaagcagcaacaatgttaagagttctactactgagtgaggggaaaaacaacttgcggctgagttaatgaagcttagtagctaccactattcaagagttaaaaaggagttcgtatgacagttcctctggagatgttatcttcaaaaagtcttatatt

SEQ ID NO: 9600 - DNA, 2414 bp, Zea mays
cacagctgcacgggtatcatatcggtagtctagtaatataataaaccgctgaagcttggttgtgcagaaggtttcgttgcattgagccgcggtgcgtggaggagcatgtggaggttaaagatcggagagggaggagggccgtggatgcagactgtgagcggcttccatggccggcaggtttgggagtacgacccggacgctggcaccgacgaggagcgcagcaaggtggagcagcttcgccgggagttcacagagaaccgcttccgaaggagggaatcgcaggacctcctcatgcgtatgcagttaactggacaaaaacatctgcttgcggatatgcgagcggccaccaaaatagaggatggcgacgaggtgaccgaagaaagtttgcaggagtcgctgaagcgagcgctggggtggatgtctggtctccaagctgaagatggccactggcctggtgattacagtgggattatgtacattatgccgttctggattttcgcgctgcacatcacaggatccatcgatgctgtcctatcgaaagagcatagacgtgagatttgccgccatatctacaaccatcaggttattggtgtatatgattggcgtggcaataatccagttgtacctgaactgtggttggtaccacgtttcctcccaattcacccaggccggttctggtgtttcactaggattacatacatgtcaatagctttcctttatggcaaaaaattcattggtcccattacaccaactatattagaactaagggaagaactctacagtttgccttatgttcagatagattggagtaaagctcgtaattcttgtgccaaggaggacatacgcaataaaccttcagaaatattcaaatttatttcaacatgcttgaacatgttcgtggagcctgtgttgaactattggccacttaacaagttaagagagagagctttgaaccacattctggaacatatccactacgaagatgaaactactcaatatattggcatatctcccgttacaaaggcactaaacatgatttgttgctgggttgaaaacccaaattcagatgcgctcaagcgacatattccaaggatacatgattatttgtggattgctgaagatggaatgaacaccaaaatatacgatggtacccacaactgggagttagcacttataatccaggccatgttatcagcagatgctgccaatgagtatggtccaaccattcagagggctatggaatacttaaagagagcacaagttactacaaaccctccagggaacccaagttactggttccggcataggtcaaaaggatcatggccactttccactatagacaatggctggggctcatcggatactagtgcggaagcaactaaggcacttttgatgatttccaaggtatatcccaacctcgttgaaaattcaaatggagatgagtggatgttgaatgctgttgattgccttctttcatttatgaacaaagatggttcagtttctacatttgaatgtcaaagaacttattcttggctagagattctgaatcctttggagagttttcgaaatattgtcgctgattacccgacggttgaatgtacatcctcggtgttgcaggcattggtattatttgaggaattcaattcagagtaccgcagtaaagaaataaaagaaaatgttaagaaagctgccatatatattgagaataatcaaaacaaggatggatcctggtacggcacatggggaatatgttttgtctatgggactctctatgcaataaaaggcttagttgctgctgggagaaattatgagaacagtatttgcattaggaaagcatgtaactttttgctctcaatacaactcaaaactggtggctgggcagagagctatcattcctgtgaaagacaggtttatgtagagggtcatagcactcatgttgtacaaactgcttgggcgatgctagctttgatttatactggacagatggaacgggacccaacaccattacatcgagcagcaaaagtattgattaatatgcaactggagacaggagactatgctcaacaagaacatgttggtagcaccaactgctctgtatacttcaactaccccaactatcgtattttgttccctgtttgggctcttggagagtatcatcgcaaagtatgtaccaaaagtaattgaaaggaacccatggaatgcaaaaatgtcatatgtagtactatgttacatactaaaggaaaatcatagcggagtcgatataaccaattgtactttatataatgaaatgtaaatgggtagccacatacatgatttcaatggaccatgtagtgatgtctaacatttgattatgatgtatgtacactagtatgaatacgccaaatcgcaaataagtaacaattcagtttatgtgt

SEQ ID NO: 9601 - DNA, 2109 bp, Zea mays
cgaagcgacgactagctctgcggcctctgccccaagcgccgacgatgggtgccggtgctactgccagggacgaggagactgctaccggccgccaccatgggaggaagccgcatggcgcggcggcggagtacgcgcaggacgggtccgtggacctgcgcggcaatcccgtgctccgctcccagcgcggcggctggaccgcctgctccttcatcgtcgtgtacgagctgttcgagcggatggcctactacgggatctcgtccaacctcatcatctacctgacggacaagctccaccagggcaccgtcgaggcctccaacaacgtcaccaactggtccggcaccgtcttcctcacgccgctgctcggcgcctacgtcgccgacgcctacctcggccgctactggaccttcgtcgtcggctccgccatttacctgctggggatggtgctgctggtgctgtccgtctcggtgccggcgctgaagccgccgccgtgcggcgccggcggggtgtgcccgcaggcgtcggcgctgcagctcggggcgtacttcggcgggctctacgtggtggccctgggcaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgccaggaagcgtaggttcaggatggactccaccgacgccatggccttcctcaacaaggccgccgccgtgcccagcggcgggtcggcggcgatgccggcgtggagcctctgcacggtgacccaggtggaggagacgaaacagatcctgaggctggtgcccctcctggcggccatgatcgtgccctgcacgctcatcgcgcagaccaacacgctgttcgtgaagcagggcactacgatggaccggcacatgggcccgcgcttcgagatcccggcggcgagcctgggcgcgttcgtgacgctgaccatgctggtggccgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccgaaggctggcctacgcgcggagccacggcctggacgccacggggggccagctggggctcaccatcttcgcgctgctcccgcagttcgtgctgatgggactggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgtcgtcaacttcgtcgccttcctcgcgctcagcgccaggtacaggtacaaggcccagtccaccgacacgatcgacgctgccgtcggcctggagaccgagaaagccaagcttcaggcggagccactgggctgacgtcgacgacgacggggtgcgtctgcctctgctgttaaaagcggagaagatcagccatgaatgcgtatcgtccaaggcgacgtgtgtagcatcaactcacttgtaaaaaaaagcacaggatttccacccgaaaccaaaagcagtgtctgcagtatcaactcccttgtaaaaaaaaagacagtccatgatctttcatttcattcacacgcaaataaaaaagtatagatcgatc

SEQ ID NO: 9602 - DNA, 1401 bp, Zea mays
ctccttcatcagtcatcacacacgcctgcggcctgcctgcctgcctgagtcctgacaccatactatacctccccctccccggccctgtcctactagccgtcagaggtttgccgcctcctcgctcctcgtcttcatcaccatctctctctctcttccttcgtcctcgacctgtggccacctgtggcgtcacgctttataagagcacgcggccggcaaccatctcccttgccacccacgagtcgagaagaagcttttgttgctgacgcctgagacgctgccactgccgccgcgccgtttggagagaaagagcagagggacactgaagcagaggagccgaggggtagcgacgagagacgagcgagagaggccgacggagatggaagcaggaggagcaggagcggagggggtgatgagggtgctgctggtggacgactcccccgtcgaccgccgcgtggcgcagctgctcctcagcagcaactcctgcgccggctcattccacgtcatcgccgtcgacagcgccaagaaggcgatggagttcctcggcctcaaggacggcggcaaggagcaggccatcgacatggtgctcacggactactgcatgccagagatgaccggctacgacctgctcaaggccatcaaggcgctgaacccgctgaagccgatccctgtcatcgtcatgtcgtcagaagacgagccccagaggatcagccgatgcctgaacgccggcgccgaggacttcatcgtgaagcccctgcagagcaaggacgtgcagcgcctccggaactgctccacggccgcgagacccagcaacaagggcggcgccacgttgccgtgcgaggagaacgccgtggccaagtggagtaacaacaagctgccgccctccgccggcgccacgtcgccgtcgggacggcgggcgaacctcgccggagtcgccatgcgccaggtgctgcactcgtcgagcgtggagatctcgcagtacctgccgctcctgctcaagctcgtcgtgctggcgtacgccgcgctgtgcctgggcgagctcctgcacagatggtcgtcgggcggcagctgctcgctctccccgtggtgcgcctgataaggaaggagcaagcagcgcaaaaagccagcaacggtgcaagagccccccctgggcaccgacgacaggagactgctgatgcaccaagcattatttcagaggctccaatagccctagtcttttaatttaggtagagattgtctgctctgagatcctaaccggggtttcgaccgatgatgagtctccccgtggcttttgttcgttgatttgaggggccggggccgtagacgtaggaaggaggaggaacggaacgaaccccttgtatcctctgctctgtatagaatgaatgaatcagaatgcaacgcgtc

SEQ ID NO: 9603 - DNA, 1891 bp, Zea mays
tgttccaagactcgcttcgcttctaccccagccgtcggacggagctcctcgcagtcgcagcagccgccgatcagcctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggaccttcgccaaggtccggtttgcgaagaacaccgaaaacggggaacctgttgctatcaaaatccttgacaaggagaaggttaagaggcacagattggttgagcagattaagcgtgaaatttgcatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactgccacagtaggggagtgtatcacagagacttgaagctcgagaatttgctgcttgatgctgcaggaaatctcaaagtttctgactttggtttaagtgctttaaccgagcaagtgaaggctgatggtctgcttcatacaacatgtggaacccccaattatgttgcccctgaggtgatcgaggatggaggctatgatggtgcaactgcagatatctggtcttgcggagtaatcctctttgttcttcttgctggatatttacctttcgaggatgacaacatcatcgccctatacaagaagatttcagaagctcagtttagctgcccctcttggttttcagctggggccaagaacatgattaccagaattcttgatcccaatcctacaactagaatcacgatttctcagatactggagcatccttggttcaaaaaggggtacaagcctcctgtttttgacgagaaatatcaaactagcttggatgacgtggatgctgcttttggagattcagaagaccggcatgtgaaagaggaaactgaagatcagccaacctcaatgaatgcattcgaactgatttcactaaaccaggcactgaatctggagaatttgtttgaagcaaaggaggagtataaaagagagacaagattcacctcacagtgccccccaaaagagataatcacaaagatcgaagaagctgcaaagccgcttggctttgatgttcagaagaaaaaatacaagatgcggatggagaacccaaaagcaggtagaaagggcaatctgaatgttgcaactgaggttttccaaatagccccatccctgcatgtagtcgagctcaagaaggcgaagggggacactctggagttccaaaagttctacagaagcctgtcgacccagctgaaggatgttgtgtggaagtgcgacggcgaggtggacggcaacagcgcggcagcatgaaagtgccctttgaactttccactggacggcgccggttttcctttgtacatagcttctctttcggatgatcccgtgtccattgcagagtcggttttgcaagcaagttctttggtttatttgtagtaagcccggtgaaacaaccgccctggaggctgttgtggatgagcttactggcgtgtttagttcgtttcatggtcgggaggttggatggaatggaaaccacaatcaaggctgtagtagtgtgtgtagtaacgaagtagatacatgcatcagatggtgtaagggagtaccagctgttagttcatggtttcaagcttagccccccttcaatttgttcgatgatgtattacttcacaataaacattattacttagatgtatgaggtgagc

SEQ ID NO: 9604 - DNA, 1673 bp, Zea mays
cctgcccacgcgacgcgagagcgggagcggtgggtcgagggacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgctctaggccgcggagcggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtagtgcactccgccgacgaccgcctcatccgcggcgcgcccatggacaggcactccagcttctggaagggcgccgacgtcctcgtctttaactcctacctctggtgggttgccggggacaaaatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggaagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttctt

SEQ ID NO: 9605 - DNA, 1637 bp, Zea mays
cgggtgtcaagtgaacctgaaatttgcggtgtcactggctggtatagcctgagtgtgagtgagtgagtgatcgagctagctgagctccgatcctcgctaagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgccacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggtcttgtcccgctcgctggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggctggtaccgatcgtggagccggagatcctgctggacggcgagcacggcatcgagcgcacgttcgaggtggcgcagaaggtgtgggccgagaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcaccgcccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattagtactgatgctagtcatcatatatatcgagctcgccactgcgaagtctgggagataatgcatgtatgcttgacggcgagatctgaggaaaaataatactatatatgcatgtttcgag

SEQ ID NO: 9606 - DNA, 827 bp, Zea mays; identical to SEQ ID NO: 9597

SEQ ID NO: 9607 - DNA, 1840 bp, Zea mays
gttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgccgtggtctgcggatacggtgatgtcggcaagggttgtgccgctgcactcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcattctt

SEQ ID NO: 9608 - DNA, 1139 bp, Zea mays
acgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcattaaggactaccgtggcaagattgaaactgagctcaccaagatctgtgatggcatcctcaagctgctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcgccatcccccacctcgtttcaggcgggggacgctggagcctggtccggttgggttgggaagtcccttaaactgttgtcgcttgcattttaactttttcatcgccgttcagtggtcct

SEQ ID NO: 9609 - DNA, 1240 bp, Zea mays
gcctttacggctcgcccccgtcttttcttctcgtgttctcccctccccgcgtgcgctccctttcgtggcacgactgggcgaccgccgctgtacgccagctgctcagatctcgtcgggccccttcgccggcgaccatcacctgttagggcaatgatgggaggctggggggtttcggatgggtacgagggatcaaagaggacacgaatgatgatggaatcgaatccctacttcgcagtgaacgcagggagtccattggatgtctcaaagaggtctaggattgttgaaccaggcccgccctattttggggccatgggcagcaacactggtggtgccagtggtggcttctaccagcccttcaacagcagcaacttagctggtgcaggggctagcactggcatccaaaactttccaggtgtacggctgcgaggtctcccttttgattgcaatgacattgatatctgcaagttctttgtgggattggacatagtggactgcctcctggttaacaagaatggccgcttcactggtgaggcttttgtggtcttcccaacagctatgcaaacagaatttgctctgcatcgtaacaggcagaacatgggccggaggtatgttgaggtgttcagatgtaagaagcaggagtactacagtgcaatagccaacgaggtgagccagggtggttactttgagtcggagtatcgccgctcctcacctcctccgaggccccctaagaagactgctgaagacaagggcagcatggagtacactgaggtgctgaagctccgtgggcttccctactctgcgaccactgaggacatcatcaagttcttcctggagtatgagctgacagaggagaatgtgcatattgcgatccgctcagatgggaaagctaccggtgaagcctttgttgagttcccaacagctgaagttgccaagacggcgatgtgcaaggataagatgactatcgggacgaggtatgtggagctgttcccgtctaccccagaggaggcgagcagggcgagaacccgaggcaggcattgaagaaacgaatggcttggctcaatgatctctggttgcatgtggctgcaatcgactgtagttttcacttcgcatgcttaactgtatcgcttttagattgtgttagttgtgtgtatttgacttcttatatgcgaactgaactgtaacagctttcctttgttggccggccgcacatgtacggcataatcatttatggatttttgct

SEQ ID NO: 9610 - DNA, 1737 bp, Zea mays
gtcctgcccacgcgacgcgagagcgggagcggtgggtcgagggacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgccgccgccgccggtcagggcgaggaggggggcgggccgccgctgccgttcgcggtgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactccagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaggtgctggccacgtcgcgggtgcccgtcgggctggtcaatatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaatgagctgctctactggaagctcttcttccccagcaacgatcaggtttagagatggcaatgggtacccgcgacccgatacccgatgggtatttactctattagggtatgtatgtgagctaaatattatacccatgggtctgttattggacaaaaatcttcacccaatgggtaaacgggtattagaacgttccgccttcacccatatccgttaacccgtgggtataaaatacccaatataaacttatctgaagcatgaacttggacttcagtc

SEQ ID NO: 9611 - DNA, 1706 bp, Zea mays
ggggagaggccaagaacccagccgcgaagccaagccaagcccatctgatccggcccctgctgccctgccccaggccccagctcgtctctcaggtcgccttgccgttgccggttccgcgcccggctcacagagtcgcaagctcgtctcgcagatccgttttcgcttgcttgaattctgttctttgggagcaaagaggtgctggccggtggcgtggcttggtgctctggggccggcgagttttttttgcgtccgctcgctctgcctgtagtcttcttgctgcggcggcggggtggagatgggggtggcgggggagaagttccagctggggacggtgggggcgctcagcctctcggtggtgtcctccgtctccatcgtcatctgcaacaaggctctcatgagctcccttggtttcaacttcgccactactttgacaagctggcatctcctggttacgttctgttctctccatgtggcattatgtatgaagctgtttgagcacaaacctttcgatgcaaggaccgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcaacacagctcctgtaccagtcatgcccataccaggcattgacgttgttccttgtcggtccattcctcgatggatttttgaccaaccaaaatgtctttgctttcgactacacaactcaagttctgtttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcgaaggagggtgaatcgaacccgctgatctcggacaccctgagcgctgccgaaaacggaggcagtgccaccgacgacgaacctctgaaggtaccaatgtggagctcgaagtactcgaaggcgtgaagtggctgttctggtattagtgcacacggtgctatacagaattcagcgtggtaggcagatactagggttggaaggcaaccctgttcctgttccatttttggccttctattttttcttcttcctggcacaaatactataaatatgtgctgtcagtaaatggatctcactcttgagaggaatacctcagctcgagaccgagtgttctgttctgcctgaaagctagtatttgtttgtgctccactccacgtgtaaagtggtagatggacatgatctcaacagtagtagtttgcattcttttgtactagtgatatacaatatttatgtattcctcgtgttccct

SEQ ID NO: 9612 - DNA, 770 bp, Zea mays
tcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacacagaggtcccgcggcttcggcttcgtcaccttctccacggaggaggcgatgcggaacgccatcgagggcatgaacggcaaggagctggacggccgcaacatcaccgtcaacgaggcgcagtcccgcggcggccgtggaggcggcggcggtgggtacggtggtggccgtggaggcggcggctacggcggtggcgggcgccgtgatggcggcggcggctacggcggtggcggcggctacggtggtggcggcggctacggtggtggcggcggcggctacggcggtggcaaccgtggcggcggctacggcaactccgatgggaactggaggaactgagcggtggggcccgcgcggccaagttatcctgttcgctgccgtgttgtttaccctagtccagagggtttatcttcgttcttgtcgtgtttgttgttgcccatctgtgtttttgattgcaaggtcgctctgtgtcagttgttagtgctgtgttcatcctcggctccagcagacccatgcatcaaccagcatggactgcggatcgatggatgctgttacccccgtcaggctttattctaagttaatcttaaggaaaaaaatggtgcttcttggtgctgc

SEQ ID NO: 9613 - DNA, 1692 bp, Zea mays
gcgggagcggtgggtcgagggacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgctctaggccgcggagcggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtagtgcactccgccgacgaccgcctcatccgcggcgcgcccatggacaggcactccagcttctggaagggcgccgacgtcctcgtctttaactcctacctctggtgggttgccggggacaaaatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggaagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccgccgtgccggacacgtggaacgagctgctctactggaagctcttcttccccagcaacgatcaggtcctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaactgtgcctcccatatatacatcactactgatact

SEQ ID NO: 9614 - DNA, 1517 bp, Zea mays
gtctcctctccaagcgggcagcgccgctttataactcgtcctcgggagccgggaccccaacgccgcctactccgcgctcctccaaaccgaatcctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggccactatccaagggtttgaatcaaagggcttttcaaaagaacaaagtgaaaacttgttaacaaagagtgttcagattgcagtggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacatcaatatcccttcatggctttccttcaactcaaaagatggagtgcatattgtgagtggtgattcgttaattgaatgcactactattgctgacaagtgtgcaaaggttggtgcagtcgggataaattgcacacctccaagatttattcatggattgatactctccattcgaaaggtcacagacaagcctattctgatatatcccaacagtggtgaaagatatgatggtgaaaaaaaggagtgggtggaatccactggtgtgtcagatggtgattttgtttcttatgtaaatgaatggtgcaaagatggggctgcgcttatcgggggctgctgcaggacaactccaaacactatcagggccatacaaagaactctaaaccaaggctgcaacaagcatcagttacctgtagcatagatctgtgctccactcctgacgccctcctcccagcagtaccttgagctgtatccccgagattccttaaccagcgaaccaatatactgttgcgtgttctcctgcaaatgagatgttctgcacctatgtttgtaatgttgtatttctgggttctaagctatccaacttggagatacaaccggtgaggaagcagcaacaataggtagttctacttctgagtgaggaaaaacaacttgcggctgagttaatgaagcttagtagctaccaccgttgtatgacagttgctctggagatgttatcttcattaagtgcttatattaccgctacttccctgtgaaatttgttaaaccattatatgtaagttttgtttgac

SEQ ID NO: 9615 - DNA, 1112 bp, Zea mays
ggcaactatagctagggttctccttctcccctccctcctccgcttgcgcttgctcttggacggtgcttcctcttctttaccagctagtcaaagtaaccacgcgtgctgcttcatctctcccttccttcctgccgtgtggttgttggctgccgcagcggcggcgcccgcgggtggaggagcaggagcggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaagactgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgatcgcttgcccttctccactctagataggtctggattgggggagagcagcagtgctggatcgggaagacccaagtgaccaacgcgtcgcatcagaataaagcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtactcgctataatcaccctgcaattacctgcagctggtcattgttaggagaaattccagtccatgcaaatgaactccc

SEQ ID NO: 9616 - DNA, 1641 bp, Zea mays
tcaaatatccttcctaatagcaatgatgctaatgatgccctctctctaatcagctttctcaccgacggcgaccgaccgaccagccatataataaagaagcgaagcgaagcgagaccggaggggcacgagcgccaccgcatcccgcccgctcctccccgatctcctcgccattgccgccgccctgccaggattcgcgccctactcgcccagatccgaccgcggctctgattttccaaccgacgcaggagcggtacaccggacagcgtgatccctgcggctcgattgtaaattcgtgatctttcggggcattccttggtttgtctgtcggtgccggtggtgctgcgtttggagggccgcggagatgggcgtcggcggggagaagttccagctggggacggtgggagcgctgagcctctccgtggtgtcctctgtctccattgtcatctgcaacaaggcgctcatgagctccctcggctttaacttcgccactaccttgacgagctggcatctgctggttacattctgctcccttcatgtagcattatggatgaagttctttgagcataagccttttgattcaagaactgtcatgggatttggagtacttaacggaatctccattgggctcctcaacttgagtcttggcttcaactctgttgggttttaccagatgactaagctggcaatcatcccgtgcactgtcattttagagacacttttcttcaggaagaagttcagtcggagtatccagatgtccctttctgtgcttcttcttggtgttggtgttgcaactgtcactgatctgcaactcaatgctgtgggatccatactgtccttgctggcaattatcacgacttgcattgctcaaattatgacaaacactatccagaagaaattcaaggtctcatcaacccaactgctttaccaatcttgcccttaccaatcactgaccctgtttctcattggccccttccttgatggctttttgactaaccaaaatgtctttgcttttaattatacatctcaagttgtgtttttcatcgtcctgtcatgcttgatatctgtttcagtgaacttcagcactttccttgtgatcggaaagacatctcctgttacttaccaagtcctgggccatcttaaaacatgccttgttcttgcttttggttatgttttgcttcacgatccgtttagctggagaaacatacttggaatcctaattgctgtagttggaatggtcttatattcatacttctgcacagtggagacccagcaaaaaaatgttgaagtctccccacaacaggtgaaagaaagcgaggcaggccctttgatcgcagactctatgagcaaagttgaaaacgggggtggtggtgttgatgacgagcctttgaaggtacccatgtggagctcaaagtactcgcgggagtgaaaaggtcacgatggcatggcaccatacaggattcaatttagtaggcagatagtagggttggaagccaacccagagtgtaatgaacatttcagttacatttttgggcttctttagtgtcgcagtctactagcagttaaaggatctgtttcttggaaggatcttaccttcagggctctcagacctaccttgaaactagacagcagcaattgtatgat

SEQ ID NO: 9617 - DNA, 1166 bp, Zea mays
ctagcttcttctagctctagctaggctcgtttgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcagggcgatcccgttcaagagtaggtcttaaaggagccgatgctgctgcttcgagatgccggtcttaaaaggatggattcgtggctgttttcaaatgatcccctactatgttacgtggagtcccattcctctttcaaagttcggaagctgcttttatccgaacccatacttgtaattcatctgtaccaattgtgtaatatgccgcgcctctgttatgtgcaattcaaaattatgagacagcgagtcaagctttaagagttcatccattc

SEQ ID NO: 9618 - DNA, 1175 bp, Zea mays
ctccggtccagtcctcctctgagtcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgctcccgccaacgttgccatcgcggtctcgcgcctcggcggcggggccgccttcgtcggcaagcttggcgacgacgagttcggccgcatgctcgccgccatcctccgcgacaacggcgtagacggcgacggcgtcgtcttcgacgcgggcgcgcgcaccgcgctcgccttcgtcaccctgcgcgccgacggcgagcgcgagttcatgttctaccgcaaccccagcgccgacatgctcctcactgccgacgagctcaacgtcgggctcatccggagggctgcggtctttcactacggatcaataagcttgattgctgagccttgccggacagcacatctccgtgccatggagattgccaaagaggctggtgcactgctctcttacgacccaaacctgagggaggcactttggccatcccgtgaggaggcccgcacccagatcttgagcatctgggaccaggcagatattgtcaaggtcagcgaagtcgagcttgagttcttgacaggcatcaactcagtggaggacgatgttgtcatgaagctgtggcgacctaccatgaagctgctcctggtgactcttggagatcaaggatgcaagtactataccagggatttccatggagctgtcccttccttcaaagtacaacaagtcgatacgactggcgcaggcgatgcgtttgttggtgcgctgctccgaaggatcgttaaagatccatcctcgctacaagacgagaagaagcttgtggagtctattaaattcgctaatgcgtgtggagcaatcaccgccacgaagaagggcgcgatcccgtctttgcccactgaaactgaggtcttgcttctaatagagaaggcatagatagatcactgtaattgctttggttttcactagcttccacttctgcaaattgcaaaatgtattgtattctgatctggaacagaagaagtgggtgttccatcttacctgcc

SEQ ID NO: 9619 - DNA, 1814 bp, Zea mays
ctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacaagaacatgttcggtggccaacggctgcacgtctgtggcgagggccatgaaccttttgtttcgtacgagggccttgagcagctgcaccggtttctcttcatccttggtatcactcatgtgttgtacagttttgtaacagtggttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatacttatttggatgctttgctttttgcgtcaattcaagggctccataataaggtcagactatttggcactgaggttgggctttgtcacatatcacaagctaccacattcatatgacttccataaatacatggtacggagcatggaagatgattacaatgggactattggtatcagttggccactttgggcatatgcgattgtctgcatattaatcaatgttcatggtatcaatatatatttctggttgtcctttgttcctgttattctggtgcttctagtgggtactgaacttcagcacgtcattgctcagttggctttggaagtcgctgaggcaacagcgccttatgttggctcacaacttaaactgcgtgatgatctattttggtttggaaagcctcgggtactctggtggcttatacagttcatttcatttcagaatgcttttgagctggcaacattcttatggtctctgtgggaactcagtgcacaaacatgtttcatgaagcactactacatggttgccattcggttgatttctgggctcctagttcagttttggtgcagctacagcacactgccgctgaatgtgattatttctcagatgggttccaagttcaagaaatcactggtctcggagaacgtgagggagtcgctgcacagctggtgcaagagggttaaggacaggagccgacacaatccgctcttctcgcggaacgggaccctcacgaccagatccgtgtgctccctagacaccacctacgagacggatcacgagacgaacacggtgtgcacgctgtcgaggacggcgtcggcgacgtcgctggacgaccagttgaccgtggtcaccgtcgatgacgagccgtcctgcattgagaaggatgtctgacgcagttgctgattcgccaaaactacatactgcaccgacctgtgtgttaggaggtactctaggactgaaatgaatgtatatgtgcagtggttgcccctatcgtggcagtgaccatgtgtatatatagaactaaaaaaactataatgtctcttagctgagagtgagaggctgtacatggaaatacttgaggcagcttggaccaaatacaaaactgcatcttttcgagat

SEQ ID NO: 9620 - DNA, 1359 bp, Zea mays
gcgctagctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcctgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttttttg

SEQ ID NO: 9621 - DNA, 1814 bp, Zea mays
ctcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatg

SEQ ID NO: 9622 - DNA, 1999 bp, Zea mays
ccaaaagtgaactgtgaaccggacgatccaggcatccagctaaccgcttccccctcgtcgcgctcgcgccgcgccgcgcctcgcctccaccagctacgccgtcacgcgagctcacggcccgggggcctcggaagcacaaccaccacgcgtccacgccgaagccacgaggagagcctgtctctcctccggggattctatcgccggctggtctcagcggcgccacttggagcaggcggcacccgctccgtactgctgctgatttggtgagcgcgggcagccgcgggatgggagatctggtggcgtgatggtgagcccgggcagtaaccggggcggcctgtcgcgcgtatcgacgcggggcggcgtcgccgggccggggagcccgcgcgcctctcctgccgcgaccgctttcgcggcgctacggcgcaggtggcggtgggcgcccccgggctcgtcgacgctggagcgcgcggcccgcgcgttcctgctggcctccgcagcgctcgtgctctcctgcgcgctctacctctacgtgctgcgctacgtcggccggggaggtcgcgccttcgccgccgcgggcttcgtcggggacgccgtcctgggcctcggcggcgagccgtgcgacgtgttcgacggcgcctgggtgcccgacgacaccggcctccgcccgctctacaatagctccgggtgcccgttcgctgagcgcgggtttgactgcctcgccaacgggcggaacgacactgggtacctcaagtggcggtggaagccgcgccggtgcggcgtgccgcggtttgcggcccgcaccgcgctggagcggctgcgcgggaagcgggtggtgttcgtgggggattccatgagccgctcgcagtgggagtccttcatatgcatgctcatggccggcgtggatgaccccaggacggtcttcgaggtgaacgggaacgagatcaccaagacgatacgccacctggcggtcaggttcgcgtctcacggcctcaccgtggaattcttccggtccgtgttcctcgtgcaggagcatcctgccccgcggcatgcccccaagagggtcaaatccactttgaggcttgacaggatggataatttcagccggaaatgggtcaattcggacgtactgattttcaacactgggcattggtggacaccgaccaaattgtttgatacgggttgctattttcaggctggacgttctcttaaattaggtacatccattgatgctggtttcaggatggcactggagacctgggcctcatgggtacaaaaaagagttgatttaaaccgaacacatgtattctttcgcacatatgagccatcgcattggggggatacaagccaaaaggtgtgtgaggtaacagagcagccttcatcagaggccaaaggaaatgataagagtgaatttggggctatacttgctgatgttgtaaccaacatgaaagttcctatcacagtactaaatgtaactttaatgggatcgtttcgaagtgatgcacatgttggcacttggagttatcctcccactatacttgattgcagccactggtgtcttcctggagtccctgatgcttggaacgaactcgtgttttcgtaccttttgacaaatggttggcgaaacatggcgggctgaattttttggcagcacaatctacccgcacctattgcattgtgatatttgacattaccaggtatactagagaattaacatacgtccgggacaaggcagctgcagctgctaggtggttcactggacttctacattcttttcttctttttgatttttgactcgtatacacggtgaagcatgctacatgcaactagagttgtatgtagttggtaagggattagaaggccttggcattcgttctatttgctcaatttactaacggttcattttattatgttgttaaaaatcgagtttgtattgtaacctgtatgtacaaacatttacttgatacattgtgagaaagtgccctctctcaattggattgat

SEQ ID NO: 9623 - DNA, 1401 bp, Zea mays
ggagctagctagccagcaacgcgtagcaagcagcgcaagcaaagctccgagcgcccggccggctagcttcgccatgaacatgggtggaaggtccccggcggcgacgacgatccggtgcaagtactgcagcgcgagcctgaccgtgtgcgccggcgagcgcgccatccagtgcgcgcaatgctgcggcgtgactcgcatccggcggtcgctgtcctcgcggctcccgctgccggcgctgacgaggccggcttccgtcgcgggcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgtttt

SEQ ID NO: 9624 - DNA, 1380 bp, Zea mays
cttcgcctacggccgtccctcctccccgtgcggcccggcgcggcccgcccgcgagatcattttctaccaccatgttgttccatacaacgaaatggtgaaggacgaatttgcttttctagccaaaggacccaaggtcctaccttgcatcaccatcagaaattcttcgaatggaaatcctcctattgtaggatatcacatcggtcattaaatacttctgttaatgcttcggggcaacagctgcagtctgaacctgaaacacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcactggtttgctggaggcagtggtagctgcccttttcatgaatatctatattgttggactgaaccagttattcgacattgagatagacaaggttaacaagccaactcttccattggcatctggggaatacacccttgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagttcgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggt

SEQ ID NO: 9625 - DNA, 2486 bp, Zea mays
cggacctggctacgaagcgcaggcagtacagacagcaccgcctggtttgagcggctgccgccgctgcatatactccctccctgccttccagtgccaggggtgaccggcgtgcgtgccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgccgtggcgcgagcaggtcaccgcgcgcgggatggtggcggcgctgctcatcggcttcgtctacacggtgatcatcatgaagctgagcctcaccacggggctcacccccaccatgaacgtctccgccgcgctgctcgccttcctggcgctccgcggatggacgcgcgccctcggccgcctaggcattgcatgccgccccttcacccgccaggagaacaccgtcgtgcagacctgcgtcgtcgcctgctacaccatagggttcggcggtgggttcgggtcgttcctgctgggcctggacaagaagacgtacgagctctccggggtgagcacgccgggcaacgtgccggggagctacagggagcctgccatcggctggatgaccggattcctcctcgccgtcagcttcgtggggctcctcaccttgcttccactcagaaaggtgctcgtcatcgactacaaactcacttatccaagtggaacagccaccgcggttctcataaacggattccacacacctcaaggagataagaatgcaaaaattcaggtccgtggattcctcaagtacttcgggatcagcttcctgtggagcttcttccagtggttctacaccgccggcgaccactgcggattcgcccagttccctactttcgggctccaggcttttaaccagacgttttccttcgacttcagcctgacgtacgttggtgctgggatgatctgctcgcacctcgtcaacctctcgttgctgttcggtgccgtcgtttcctggggcgtcatgtggccactcatcggcaagcagaagggcaactggtatccggcagatgcatctcagaatagcatgacaggcatctacgggtacaaggccttcctttgcattgcccttctcgtgggagacggtctctacaacttcgtcaaagtcatagctatcactgtcaagaacatacgcgagagatcacgtcgcaagaacctgaacagagtggcggacgcggacacgatggcgctggacgacatgcagcgcgacgaggtgttcaacagggacaacatcccgacgtggctgtcctacgcggggtacgcggcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaaggtcgcgctgttcgtgctggcggcgtgggcggggaaggacagcggcgtggtggccgggctggtggggtgcgggctggtgaagcagctggtgctcgtgtcggccgacctgatgcacgacttcaagacggggcacctgacgctgacgtcgccgcggtcgatgctggtggggcaggccgtgggcacgctgatggggtgcgtcctggcgccgctcaccttcatgctcttctacagggcgttcgacgtgggcgagccggacgggtactggaaggccccctacgcgctcatctaccgcaacatggccatcctcggcgtggagggcttctcggcgctgcccaggcactgcctgcagctgtgcgcggggttcttcgcgttcgcggtgctggcgaacctggcgcgggacctgctgccgcgccggctcgcgcggctcgtgccgctgcccatggccatggccgtgccgttcctcgtgggcgccagcttcgccgtcgacatgtgcgtggggagcctcgtggtgttcgcgtggcacaagctcgacggcaagaaggccgcgctgctggtgccggccgtcgcctcggggctcatctgcggcgacgggatctggacgttcccgtcgtctctgctcgcgctggccaaggtcaagccgcccatctgcatgaagttcacgccagggagctagagggcgcgctgacgatgcgtacagaacagagggcatcgttcgtcgtttgtggggtggaatccgtgtagtagaattacataccaaccaggcctgttctaatgtccatatgagcttaatgtacggtgtatatatatgtaaaaatggaaatctgaaggatgacaggatgaattgcctgttgtctagtagcacgc

SEQ ID NO: 9626 - DNA, 921 bp, Zea mays
ggattctccccacctccgccgccgtttccccgcgtgctttctctctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattttattggtgttggctacctggtcgaatggtcgtcgctccattttgttggtgacttaacaatttcaattgagaaaatatgtttcaaaccg

SEQ ID NO: 9627 - DNA, 1818 bp, Zea mays
tccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 9628 - DNA, 1368 bp, Zea mays
gcgcggaggttacctctcgccccccctctcctccgtccctcggagtctcctcctgtcttgatttcgggtcgctgctgtttcgatcccctttcctccctgacgatttgcttatttttgcgttggatttgtaacctaaacatctcgtttccgcaccgttttggggccgcgtctactggtggttgggtccctttagatcgagtaggcgcgaggatggggacacatccccgattgatctgacgtgatacgcatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 9629 - DNA, 2482 bp, Zea mays
cttcactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatccgctcctccacccgtcctctcaccagctcaccgatttcctcacctccgccacttccacctccaccttcctcactgacgactccgtgctgcgcaccggggaggacttcaactcctcgtccaccggcgccgccggcgaggtcgccgctgggggtgtcgaagtcgtcgcggaggccgtcccgttcatcaagctctccgaagttggcgccgaggccgagaagacggagcccgagacggagcgggccgtcaccgtcgacactgatgcggccacgggcgagggtgcagcggtggcggaggaaaccgccgttgcggaggcggtttcctgcgacacggaggcgcccgtggactgcacaggagacagggaactcttcaacctgctcatgcgcgcggccatcgagcggttccccgacctccacttctaccgctttggccgtcccgtggcggtgccggggagtcccatggagtgtgacctcgcgtggcgcttccgccccgctgccgacgccatcggcaccggccggaccacatactacaaggactaccgccggttcacgcttacccgcgacgtcaacacctgcagcctcgtcgtcgacaccgtgggtgaataccactcgggtgtgggtgccaagcgcaatggacggcgcaaggggaagaaagggaagaagggaaagcaggatgcacctgtgactgacttcgtgccggttaagacacagattaggctggacgagaacaccgccaacaatgaggctgctggggctgcagcggagccggtgtttgttgttggtgaggctgtcaatgacagcttgccagtggttgcttctgagtctgatttcagccgtggtaagtaccttatttacattggtggtggcgagaggtgcaagagcatgaaccatttcatttgggggttcttgtgtgcccttggtgaggcacaattcttgaaccggactcttgtcatggacttgaatgtctgcctcaatgcacggtatacttcgagtggcaaggatgaagaaagagatttcaggctctactttgattttgagcatttgaagcaatctgcgtccgtgattgaccagagccagttctggcaagattggggacagtggcacaagaaagataggctcaagaacttctacactgaagacatcaggatgaccccaatgaaacttcgtgacatcaaggacacattgatcatgaggaagtttgggaatgttgagcctgataactattggtcacgtgtgtgcgagggtgagactgagggaataatcaagcgcccatggcatttcctgtggaaatctcgtcgcttgatggagattgtatctgccattgcctcacggatgaactgggactttgactcggtccatgttgtcagaggggagaaagcgcagaacacacaactttggccaaaccttgacagagatacctcaccagacagtctccttatggcacttaatgataaggttggtgctggccggtatttgtacattgctaccaatgaacctgacaaatcgttctttaacccactcaaggaaaagtataaaacacacttccttgatgatttcaagtacctgtgggatgagaatagtgagtggttcactgaaactaaggagctgagcaatggtcagccagtagaatttgatggctatatgaggattgcagttgacactgaggtattcttgagggggaagaggcatgtggagacattcaacgagcttacacgtgattgcaaggatggcgtgaatacatgctcagcttcttcctgaacatttggtgggctaaggaaccttggagaggactagtaaggacttgggaaaggccaagatgtcaaggacgagaagctaggatattcacaacaagagaaatccaagtctgactcaacttcgtctccacctcgaagtctaggactagtctacactaaaacagacgcccaagatgcatccgaactccgattaggttatgctttatatggatggaaacctaaggagatacgctttccaacccaactggaatcaccttaaaattcatccggagtcaacaggaatcgtcgaaacaagttagcgttcagattctgttttagtgttgcaacaccgtatgttgggctgttgggccatgtatcgtgttggagcatattagggatgcaaccaaaggtcatgcacgcccctaatctctattttatcagcaaccaccaccatattagtgtttgggttttgcttagatcatatttgtcatctaagaatttgtcgttcatcagtttgtgataccccaactcgtaatcaacacagttttggttgtgttctttc

SEQ ID NO: 9630 - DNA, 1484 bp, Zea mays
ggcgcatccactgggatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatgggacctccaatgagtggggctggtgcaaacagaagcttggagcaaatgccatccttgcggtttcacttgcggtgtgcaaagctggagctatggtgaagaagattcctctttaccagcacatcgcaaatcttgctggaaacaaaactctggtgctccctgtacctgcctttaacgtgattaatggagggtcacatgctggaaacaagcttgccatgcaggagttcatgatcctcccaactggtgcctcctcgttcaaggaggccatgaagatgggagttgaggtgtaccacaacctgaagagcatcatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaagaaaatttcaggcgacagcctgaaagacctgtacaagtcctttgtttctgagtaccctatcgagtcgatcgaagacccatttgatcaggacgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttcttctctctctctagattctgacgagtggtggtctgcactcgtcgtaatgtcgtttgcctaaactgattttgatggaacaggaaatcttgctggtct

SEQ ID NO: 9631 - DNA, 1132 bp, Zea mays
aacaaatctagggttccaagcgagcgaataccttcctccgcctgccgatctccccgcatctctcgggctaagacgattcgaggcacgagcgaagatgccgcagcggcattcgaaaaacaacaacgacctcgccttcttcacgtacgaggagaagcggaagctcgggtacggcacgcagcgggagcgcctgggaaaggactccatcaagcccttcgacgcctgctgcctctgcctcaagccgctcatcggcccgctctgctgccccaagggccacacattctgtaaggagtgcatcctcgagtgcctcctctcccagaagaaggacatcaagcgcaagctagcagcacatgaggcccagaaaaagcaggagaaagaagaggaggaagagaagctaattctgcagaaggctaaggagttggatgcctttgatcagcagaatcatggagctgttccccagtaccatgatcgcagtggttcccaatacaagaatgggtttcatggagcaaatagtgtgaaggtcacttcttttgaagaggaagcccttcgcaatatgaaggcattctggctcccttcagctactcctgaagctacggtcaaggtagacttgccctccaccgacactgtttgcccggaggggcaggagaagcttaagttgaaatcgctcttccctatctcgttcacagaggaaactgctgatcagaagagcagcaaggcaggaaactcctgtagctacatgtgccctagttgcaagtccactctcacaaataccatgtcccttgtggcggtgagcacctgtggccatgtcttctgcaagaaatgttccgacaagtttctagtgaaggataaagcttgcttggagtgcagcaaaccattcagggagaggaatctggttccattggagaaaggaggaactgggtttgctgcacatgatgaacgcctggaggcaagagatttcaagtatttgggtagtggctctgggttagggctagtgaagcctgccccaaaaacttactaaccttgaataattatagctgatgttgtgtattgtttaccatggtgtcatgaaattatgtaacctggagaattttgttttatggcatcaaaatcgttgtattcagaacagttcatcttc

SEQ ID NO: 9632 - DNA, 1066 bp, Zea mays
ctccccctctggcctctaccctgcctgccgtttccatctccatccagttctccgcacccacccacgaccacgacccacccacccactcctttccccaacccatggccgccgccgccgccgccgccggcacccgggaggagatggtctacatggccaagctagcggagcaggcggagcggtacgaggagatggtcgagttcatggagaaggtcgcggccgccgcagagctcaccgtcgaggagcgcaacctgctctccgtcgcctacaagaacgtcatcggcgcgcgccgcgcctcctggcgcatcgtctcctccatcgagcacaaggaggagacgcggggcgcggcggggcacgccgccgccgccagggggtaccgcgcgcgcgtcgaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcacactcatcatgcagcttcttcgtgacaacctcaccttgtggacttctgacatgcaggaggatggtggcgatgaaatgcgggatgcaaacaagcctgacgaggagcagtagtagccaaacatctccatcgatcatgccatgccatgccatgcttgtacaaggaccattttcgtgtgtcctttccttcaatcgtcgacctttcgttttgttgttatactgctattgtggaaccctgttactgttactgttagtgtatcctattggcaataatcaaatgtggtatggttgactactat

SEQ ID NO: 9633 - DNA, 1558 bp, Zea mays
tagaggagcacaagtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattact

SEQ ID NO: 9634 - DNA, 1962 bp, Zea mays
tgagatgatctctattcgcttggaaagtagagataggttaaatttcggtctgaacggtgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggagagaatggtgtggacaacgcggtaaatttggtgcagatggatggtgtgttcaaattgatcggagttctctggatggatacctatcgagtagtataattcctctctcagctcactgtccagacaattagtgctatctgtgactgttgggcaatcaggttatcgagattttgctggttggagctgtccggcattgctttcatcttttatcaatatgccggtctttggcagcatatggcgattcagaactgtgcgcagtggtttcctcgaatttaggaccccccaactgcattctgtattgagaacattcctgctaaatacatgatacttgcaggtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggt

SEQ ID NO: 9635 - DNA, 1684 bp, Zea mays
gcgaggcaaaagcattgcgaccacagacagcgcgcgcttcaaggcctttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactgggatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatgggacctccaatgagtggggctggtgcaaacagaagcttggagcaaatgccatccttgcggtttcacttgcggtgtgcaaagctggagctatggtgaagaagattcctctttaccagcacatcgcaaatcttgctggaaacaaaactctggtgctccctgtacctgcctttaacgtgattaatggagggtcacatgctggaaacaagcttgccatgcaggagttcatgatcctcccaactggtgcctcctcgttcaaggaggccatgaagatgggagttgaggtgtaccacaacctgaagagcatcatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaagaaaatttcaggcgacagcctgaaagacctgtacaagtcctttgtttctgagtaccctatcgagtcgatcgaagacccatttgatcaggacgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttcttctctctctctagattctgacgagtggtggtctgcactcgtcgtaatgtcgtttgcctaaactgattttgatggaacaggaaatcttgctggtct

SEQ ID NO: 9636 - DNA, 2325 bp, Zea mays
gccttccacttcgcctcctcttctctctctcccccgtctcctgtctccacctgttccatcgcattctcctcccaccaccaccacaccacgcctcgcttatccccccccgagacccgacccctgctcgacgacgtgctggcaaaacctcctcctagtcctctcgcagaaggaggctgtgttctttccttcatcggtgcggcaacagcgaaagcttctcggtcgatctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgtgatttctgtgggaaacaaaggtcaatgatctactgcagatcagatgcggcatcattgtgcttatcatgcgaccgtaatgttcattcagctaatgcactgtctcgacgtcatacaaggacccttctttgtgatcgttgtggttcacagcctgcatcagtccgatgtcttgaggacaacgcatcactttgccaaaactgtgactggaatgggcatgatgcagaatcaggggcttctggacataaaaggcaagccataaactgctactcagggtgcccatcatctgcagagctttcgagaatctggtcatttattactgatatcccgactgtagcagctgagcccgactatgaggatggactaagcatgatgacaattgatggcagtgatgttactaatcgtcacgatacttcagatgataaaagattgttggaaatagctaacacaacactcatgagcgatccaccttcagccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgacggttacttcgaattgaaagagacaccacctttttatttcaacgagcagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccgatgctcctcatgggtgagccaccctggcattctcctggtggtccagaaggctcagtcgctggaggcagcagagatagcgctctcacacggtacaaggagaagaagaagaggagaaagtttgacaagaagatcagatatgcttctcgcaaggctagggcggacgtgaggaagcgggtcaagggacggttcataaaggccggtgaagcgtacgactatgatccgctaagccagactagaagctactgagccttgggagtgtgactgttgttgtcgtccagtgtcagcctcgcaatctccagccgctcgtcggttgcaggctgcgctacaggcaagatcactggagagcacaacgatcgcattgcatcagagcctgcaactgaaaaacgttaagaagagataccaagtgttaggatgaatgaaaaaaaaatacaaaaaagaaagatgcagacttgccggactcatatccattattcagtttctctgcggatgagtggcttggatcgcactgtgccatctgcgcgtcgaacagatgcagtgatggatgggcgctcgtcgtcctccagctgtaccgctgtgcgctaggacctgcgtcggctatatacggctgttcggcagtgagctgccaggttgtacagtctgggtaacagcctaacagggtatgcttatacctctcggttttcgttctgtaatacgtacgtattatttgcgcttgccaggagactgttcttcggccgtgtgtatgtttgtagatggttgcaacattggtaaaaaaaaaagtagccgtcgtgaatgtaaatttgtattcttgttaggtcgcatatagcgttggcgatgagcaggagaatcacacgtatctggacactgaacgtctgaacccttgtaactatttttgcgccagaataaccttcttgtgccttgtcgttt

SEQ ID NO: 9637 - DNA, 1534 bp, Zea mays
cccgatcccgccttcaatcctctcggacccgaccctggccgccgccgccacctccctcctcccggccaactacaactttgagctccacaagacggcgcaccgcatacggtccgcggccgctcgccgcgtggcgctgcagctccccgagggcctgctcctcttcgcgctcccactgtcgcacctcctcgcgccctacctcgagcccggcgccgacaacgacgtcctcgtcctcgccgacgccacctacggggcctgctgcctcgctgaccgccccgccagggcgctcgccgccgacctcctcgtccactacggccactcctgcctcgtccccgtcacggcctcactcctcccggtgctctacgtcttcgtcgagatccgcgtggacgccgcccgcctcgccgccgccgtcagagccgccttcccggacccagcggccgcgccccgcctcgccatcgccgggaccgtgcagttcatcgccgcggtccacgccgcgcgcgagatgctcacggtagagggctaccacgacatcgtcgtgccgcaggcgaagccgctgtccgccggcgagatcctgggttgcaccgccccgacgctcaagaagtcggaggaggtgggcgccgtggtgttcgtcgccgacgggaggttccacctcgaggcgtttatgatcgccaatcccggggtgaaggcctaccgtttcgacccattcctcggggttctcgtgctggaggagtatgaccatgttggcatgaagcaggcgaggaaagcggcggtgctggcggccaggaaggccaagagctggggagtcgtacttggcaccctggggaggcaggggagcaccaaggttcttgacagggtggtggagcatttggaggagaaagagttggaacacacagtggtgctcatgtcggagctttccccggcgaggatggagctatttggagattccattgatgcctgggtgcaaattgcttgtccacgcttgtcgatcgactggggggagggtttcaagaagccagtgctgacaacgttcgagtttgatgtcgcactgggctatgtccctgggtggtgggagaaggggagcaggggttgcggtagtgaatgtggtgttgggtgttgttcaggatcaggaactcgtggaaactgcaactgcagtgatggggattatggtggtgactacccgatggattattattcgcaagatggaggtgattggaatagctgctacatgaagaagaagccatctactggcgagaggaaactgcgggttcggattggcaacgaaattcaagccgaggagaagcgtgggaatcaggattctcgtgagctagtcaggtgaatagggataccgagaacagcttcatggctcaaaaaggatttttgacaccaggttttagtgtgattgtaacgatgtttagttaccagagggaaaatcttgtgactgtacctgtatcgatgtatccaccaccccatatactgtaaatttgttacgtacaatgtctcattgtaaacatcttgagaaggtatgaggtgttgtcat

SEQ ID NO: 9638 - DNA, 1966 bp, Zea mays
ctacaatatatatccggctctctctgtgtgcgtgctctaactgcagcggagcctcacagttgttcgtgtgctgtgtatttgtcactggtggtgctgtgcagaccaagctactgcgggagggagaagggtgtgtgccggcccgccgccaagcactgctacccggccggcggccatggaggtgagctccgtggagttcggtcatcacgcggcggccgcctcaaagtgctttgacgacgacggtcgcctcaagcgcacagggacgatgtggacggcgagcgcgcacattatcacggccgtgatagggtccggggtgctgtcgctcgcgtgggccatcgcgcagctcggctgggtggcaggccccaccgtcatgctgctcttctccttcgtcacctactacacatcggccctactcgccgactgctaccgctccggcgacgcctgcaccggcaagcgcaactacacgtacatggacgcggttaacgccaatctcagtggcgtcaaggtctggttctgcgggttcctgcagtacgccaacatcgtcggagtcgccataggctacaccattgccgcctctattagcatgctggcgatccagagggcgaactgcttccacgtggaggggcacggggacccctgcaacatctccagcacgccctacatgatcatcttcggcgtcgtgcagattttcttctcgcagatcccggacttcgaccagatatcgtggctctccatcctcgccgccgtcatgtcgttcacctactccaccatcggcctgggcctgggcatcgcgcaggtggtgtccaacaagggcgtgcagggcagcctgacggggatcagcgtcggcttggtcaccccggtcgacaagatgtggcgcagcctgcaggcgttcggcgacatcgccttcgcctactcctactcgctcatcctcatcgagatccaggacaccatccgcgcgccgccgccgtccgagtccaaggtcatgcggcgcgccaccgtcgtcagcgtggccgtcaccacgttcttctacatgctgtgcgggtgcatggggtacgccgcgttcggggacaacgcccccgggaacctcctcacgggcttcggcttctacgagcccttctggctcctcgacgtcgccaacgccgccatcgccgtgcacctcgtcggcgcctaccaggtctactgccagcccctgttcgccttcgtcgagaagtgggcgcgccagaggtggcccaagtcccgctacatcacgggcgaggtcgacgtcccgctcccgctcgggaccgccggcggccggtgctacaagctcagcctgttccggctgacgtggcggacggcgttcgtggtggccacgacggtggtgtccatgctgctgcccttcttcaacgacgtggtcgggctcctgggcgcgctggggttctggccgctcaccgtctacttccccgtggagatgtacatcgtgcagaagaaggtgcccaggtggagcacgcggtgggtgtgcctgcagctgctcagcgtcgcctgcctcgtcatcaccgtcgcctccgccgcaggctccgttgccgggatcgtctctgacctcaaagtgtacaaaccgttcgtcaccacctcctgatcgaccgtacgtcctagcttccgtgcagttcaaaacacatacgcacgaacagatcattaattggcgcctagtatatatgtgcagtctttaattaaattaactaggcattaatcgatcgattaccactacgtcgttctagtgatgcgcgtagcttgcatcatcgctcgctgatttaatttccattgtttttctttgatgatctggttagccgaaatggctagtgaattaagagaaaacaaatagtagcagtactgtgtgagtaatcccaagtcaaatacgttattgaagttgtcggcggtacaaaacgcttgtaaaatgtttgtgtttcaattaatcaagaagaattgtacgtgtttc

SEQ ID NO: 9639 - DNA, 1143 bp, Zea mays
caattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcg

SEQ ID NO: 9640 - DNA, 1080 bp, Zea mays
gcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttccaagtttgtttacgc

SEQ ID NO: 9641 - DNA, 1865 bp, Zea mays
tgtcgatggattacttggctgctgctgtacccgtgaccttggctctgggagtgggagctatcttgttggtcttacgatggacgtactgccgccgccgaacaagcgccgaagaagcaagactgcccccggggtcaaggggcctcctgttcctgggggagacgctccactacctggcagcgtcctccaccccgggggtattgccaccattcttccagcgacggttggagaggtatggccccatcttccggacgaacctggtcggggaggatctcgtcgtgtcgctggacgcggagctgaacgcgcacgtgctgaagcaggaggagcgcggcttccagatctggtacccgccctccttcatgcgcgtcttcggcgccgacaacatcaccgccaagctcggcgtgctccaccgccacatgaggaccctcgtgctccgcctcttcggccaccagaccgtccgctccgtgctgctgcacgacgtgcagcggagcgcgcgcgacgagctgcgctcatggctcggccgcccggacgtcgaggtcaggacggccacctccaggatgatatttggcgtcactgccaacaagctgatcagccatgacgacgcagcatctggaggcacgttgtggagatgcttccacgactggacttcggggctgctctcgtttccggtttccattcccggcacaaccttctacagatgcatgcagggacgtaagaaggttatgacgatgctgaaacagcagctcgtcgagcgtcgacggaacgcagcggagcgcgagacgacagaggatttcttcgatctcgtgatcgatgaactgaacaagccagaccctatgatggacgagagcaccgcgttggacttgctgttcaccatgttgtttgcgagccatgagacgacgtccatggtattaaccgtcatactcaagtatctgactgacaacccaaaagctttgcaagagctgacagaggagcacgaaagaatcctggaaagtagggccgatccaggctctgacctcacgtgggaggagtacaggtctatgaaattcacatctcatgttatacatgagtcgctaaggctcgcaaacatcgcactggccatgttcaggaaagcaaatcaggatgtgcacataaatgggtacacaattccaaaaggatcaaagatcatgatgtgtgcactagcatcgcacttgaatacggaggtctacgaggacccctcagtgttcaatccatggagatggaaggatattcctgaaccagtcggcacctctaaggactttatggccttcgggggtggtttgcgcctatgcgctggtgccgagttttccaagatgcagatggctatgttcctccattacttggtcacaaattacagctggaaacccgtcagcggtgggacaatgttattctatccaggactgcaatttccagaaggcttccacatccagcttcttccaaaaatcccaaacgtggttccataaaccctatgaagaaatatgaatacgaataatttaagcaaatattctaaatgtaccctggggaattgaagttcgataacgatgtggtacgggctgatttggtaaccatggatcacaggaggatgggagaggattgatggagaaattagttcatttctccctcaacctctttcaatcctcttatgatccacttatcaccaaatcaaccctaatgatagcaggtcgaattgtcggaacaaataatagtttcaccaaacagaaggggagtatgcatgtgtgtaactttttatagttataaataatagtagagtaaattcagctcgttgtgtaacaactatgcaggtgagtaaaaattggttcagcatattgtatatattatgcccagttcaatgg

SEQ ID NO: 9642 - DNA, 1758 bp, Zea mays
ggcaacagcagctatagtttccaagggaaagggatacatcacctgctgctctagctctgctatagcgctagcagcaatataatggcggccgtcggcgccccgggcagctctctgcacggagtcacggggcgcgagccggcgttcgccttctccacggagcacgaggaggcggcgagcaatggcggcaagttcgacctgccggtggactcggagcacaaggcgaagagcgtccggctcttctccgtggccaacccgcacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctccgtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcgccgtcaggttcctcatcggcttctccctcgccaccttcgtctcctgccagtactggatgagcaccatgttcagcagcaagatcatcggcaccgtcaacgggctcgccgccggatggggcaacatgggcggcggcgccacgcagctcatcatgccgctcgtctacgacgtcatccgcaagtgcggcgccacgcccttcacggcgtggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgcacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcgcgccccatgggcggcatcatgtccgacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgggcaggcggcctgcggcgccatcttcggggtcatccccttcgtctcccgccgctccctcggcatcatctccggcatgacgggcgccggcggcaacttcggcgcggggctcacgcagctgctcttcttcacctcctcaacctactccacgggcagggggctagagtacatgggcatcatgatcatggcgtgcacgctacctgtggtgttcgtgcacttcccgcagtgggggtccatgttcttcccgcccagcgccaccgccgacgaggagggctactacgcctccgagtggaacgacgacgagaagagcaagggactccatagcgccagcctcaagtttgccgagaacagccgctcagagcgcggcaagcgaaacgtcatccaggccgatgccgccgccacgccggagcatgtctaagtctactactaataagatggatcgatccatcatccatgttcacctgctacctacctctacgtgtatgccttgtaacgcgccggaccggagcacttgtttgat

SEQ ID NO: 9643 - DNA, 1461 bp, Zea mays
tcgcaccccagatcccaatgcgccccgccgcgccgcactaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactacagcttctggaagggcgccgacgtcctcgtcttcaactcctacctctggtgggtcgccggggacaaaatccagatcctgaggggcgccgacaacgacccgagcaaggacatcgtggagatgaagtcggaggaggcctaccggctggtgctgcaccaggtggtccggtggctggagcgcaacgtggaccccggcaagtcacgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgaattggtgcctgcatacatacgcctggaaaccaactgctaggggctagcccaaagaaaatgtgtctagatgaacaaagacatggggttcaaatgttttgttttgatttcggatatggacgctgtcgatgctcttgttctc

SEQ ID NO: 9644 - DNA, 1925 bp, Zea mays
tcttgccttcacacccgggacgggagttccttgctagggggagagcttcccttgctcgtgtcctcactcacgcactcacagactcactcattcaccgacggtcccagtggactgaggtgagacttcggtcggagccggccggacggaacatacaggatggccgccgcgccgccgcccaaggccgacgagctccagccgttcccgcccaaggagcagctgcccggcgtcgccttctgcatcaccagccccccgccatggccggaggccatcttgctagggttccagcatttcgtcgtcatgctgggcaccaccgtcatcatacccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaacgaagcagaccctcacgagggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtcgaagttggcctcccagaactgctcctgttggttgtgttttctcagtatctgcctcaggttctggacttcggcaagtccgtcttcagccggttcagcgttctcttcaccgtcgccatcgtgtggctgtacgcctacatcctcaccatcggcggcgcttacaagaactctccgcccaagacgcaggtgcattgccgcgttgatcggtcgggccttatttcaggagcaccttggataagtgttccctatccctttcagtggggtgctccgacgtttgacgccggagaagctttcgctatgatgatgacttcgttcattgctcttgtagagtcaactggcgccttcatcggtgcttcgagatatgcgagtgcaactatgattcctccatcgattatcagtcggggcgtgggatggcagggcattggtctgttgctcgattcatttttcgggacagcgaacgggacatcggtttcagtagagaatattggactgcttgcgttgacacgcattggcagccggagagtggtgcagatatctgcaggcttcatgattttcttctctgtccttggaaaatttggagctttgtttgcgtcgattccgctgcccgtatttgccggcatgtactgtctcttcttcgcatatgttggtggcgttggcctgagcctccttcagttctgcaacctaaacagctttaggaccaagttcatcatggggttcgctttcttcatgggcctatcggttcctcagtacttcaacgagtacacagccgttgcaagctatggtccggtgcacactggcgccagatggttcaatgacatgatcaacgtgccattcacgtcgaagccgttcgtcgctgggttggtagcctatatcctggacaacaccctccaggtaaaggagagcgcggtgcggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaattctggaagcaacccttgttcatatgggcgttaatgaggaacataattctgctggtctggccagtggaagcttctgtgtctccattgttggtcaattttgtgtgttttcggacgagatgggagtaattgaactgtagaaattattacgattgaagtatatcgcgttctttttgtaatct

SEQ ID NO: 9645 - DNA, 2097 bp, Zea mays
agacaagccaaacgagggcatcccttcttcagccgcacgcttcttgttgccaaagaattccctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 9646 - DNA, 1524 bp, Zea mays
gtcgacccacgcgtccgcttgcacttgggtgttacagaagctggagagggtgaagatggaaggatgaaatctgctattggcattgggacactgctaatggatggtttgggtgatacaatccgtgtctccctcacagaaccaccagaagaagagattgatccttgccaaaggttggcaaatcttgggacgcaggccgcaaaccttcaaattggggtggccccatttgaagaaaagcacaggcgttattttgatttccagcgtaggagtggtcaattgcctttgcagaaggagggtgaggaagttgactacagaaatgtcctgcatcgtgatggttctgtactgatgtcagtttccctggatcagttgaaggctcctgatctcctttataggtctcttgcagcaaagcttgtggttggcatgcctttcaaggatctggctactgtagattccattcttttgagggagctcccccctgtagaagatgctgaagctaggcttgcactcaaaagattagttgacatcagcatgggcgtactggcccccttatcggagcagttgacaaagccactcccacatgcaattgtacttgtcaacctcgacgaattgtcaagtggtgcacacaaacttttgccagaaggcactagactagctgtcactcttcgtggtgatgaatcatacgagcagctagatattcttaaggatgttgatgatataacaatgttgttacataatgttccatatggtgaggagaagacaggcagggtgcatgctgctaggaggttatttgagtacttacaggccaatggcttgaacttccctgtaattcatcacataaatttccctgaaaccattgacagagatggtcttgtcattggtgctggggccaacgttggtgctctcttagtcgatggtcttggtgatggtgtattccttgaagctgctgaccaggaatttgagtttctgagggacacatctttcaacttgctccaaggttgcaggatgcgcaacacaaaaactgaatatgtgtcttgtccttcctgcggccgaacactctttgaccttcaggaaatcagcgctgagattagagaaaagacctctcatctgccaggtgtctcgatcgctatcatgggctgtattgtcaatggaccaggagagatggctgatgccgattttgggtacgttggaggcgctcccggaaagatcgacctttacgtcggcaagaccgttgtgcagcgcgccatcgccatggaaggtgccactgacgccttgatccagctgatcaaggaccatggccgatgggtggatcctcctgccgaggagtagggctgtaggctgtagccaagtctgtagtttatatattctgtaaagcgaaacacgcaatgcagtaactgagcatacgatgtacatccctacacattttgtacatttattgagatctgagaaataaactagaaaccgtcggtgacggcatgtctgccgcaaaaaaaaaaaaaaaaaaaaaaaaaaaaaaaaaagggcggccgc

SEQ ID NO: 9647 - DNA, 1176 bp, Zea mays
ggctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 9648 - DNA, 2748 bp, Zea mays
tcttgatattattccggttgacaaagatggtggcacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggtatgtctgatgctgtactgcaaacgctagctcgacacatggagcgggctgctgatgacataaaggccaggtatgaaattctgcatggtgagaaaactaaggattcttgcaagaaagggactgagcataatgtcaaagtggaagatttgtactgtgacaaagatttggatgcagcattggattcttttgacaatctcttctgtcgacgatgtctagtgtttgattgcaagctacatgggtgttctcaagatttagtatttcctacagaaaaacaaccagcttggagtggcgttgatgacagtgtaccctgtggtattcattgccataaactggcatctgaaccagattctgctgctggtgctgatcacatgctttttgatgttgaggagccaactcactcatcagacaatgtgatgaaccagccaggttcaaataggaaaaagaacggctccagtggaaggaagactaaatctcaacaaagcgaaagctcttcaactgcaagagttatctcagaaagcagtgattcggaagtacatccaataagcaataaatctccacaacactcccctagtccctcaaaagttaaaattgggccgaaaggtggaatcagaaagattaccaatagacgaattgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgttaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcaggaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagcccctgcttgggcccgtaagcctgaggcgtcgggagcaaaggatgatgggcaaccgttcaatgggcgtgcaaagaagctcgcccaaaacaacagaggctgaatctgatttgattctttcattgttaggacaaatttggcagccattcaactaatataaggaacctgtcattcataggccccaatttatttgaactcgtcattgtaactcgtatgtgcttgaattctccatggcagctggtcctgccatccgtagagttaggtcccgtttgttttgaggaactaaaaattaatccctctattttagtcatattgagtctctagattgtccaacagcgggactaaaacaaagactaaactatttgtctctagtacctcaagccatgactaaaagggaataaatcatataaattttatttt

SEQ ID NO: 9649 - DNA, 911 bp, Zea mays
aaagcctgaactgaaataagaacgaagtggaataggacgaaggaaggttctgcatctcagattgaatgtcggaaggaaagaagtacttgattgtgttggctcaccatgagcccaagtcgctgaatcactctttcgctcaacgtgctcaacaggtgctcacggctgctggaaacgaggtcaagctgatcgatcttcatgccgtcaacttcaacccggtctcggatcgacgcaacttcaagacgacggccaacccggagtttctcaaacaacagatcgaggagcgacatgctaccgaacacgatgggttcgctgatgacatcaaggagtccctggaggcagtcgactggtgcgatgtattgattctccagtttcccttttggtggttcagcatgcccgccatcctcaaaggatggatcgacaaggtctgggccagtggaagagtctacggtccgaacaagaagttcaccgctggagtgtggaagggcaagaaggccttcctctccatcacaacgggctcttccgagccgacctacgcgggacctgactctcgcatgggagatatcaacagtctcctcttccccatcaaccatggcatcttagccttcgttgggttcacggtcttgcctcccttcatcgcctactcagcttcgcatgccaccgaagaccagaggaagcagttcctggatgagtacgaacagagacttctgaacctggagaacctcaccccgatctcctatcctcccaacgaagccttcgactccaccggaatcctgaaagcagactggaaggctgctcaagctcaccagaactcgaaccctgctccacgcgaaggctgaaagcctccctcattccctccttccatctgaatgaaaccagctgttggcataccgaggtagcaacttcgaaacatc

SEQ ID NO: 9650 - DNA, 1130 bp, Zea mays; identical to SEQ ID NO: 1734

SEQ ID NO: 9651 - DNA, 1861 bp, Zea mays
gcggaagagttgcgggaggaggaggagggtggcgggcagcggaagaaaatgggcgggatcccaagggagccgtcgttctcgcggtggtgcagggacccctctgccgcctccgcctccaataccgccgctgctgcggcgaccagtgacagcgacgcctcagaggagttcgagctgccgcttctgccatcctcctcgggcggcggcggctcaccgatggacattgaggtgggggcaacggcgagatctgatgatctgccgatctcgccgaggttgcttgcgaaggtcatcgggttgatagcgtgttggtacacactgagcacgtgcttgacgctgtacaacaaggagatgctgggaaagcacatgtggaagttcccggcgccattcctgatgaacacagtgcatttcacgatgcaggccgtggcgtcgagggccatcgtgtggttccagcaacgaggtctagagggagggccaagtaaaatgtcgtggaaggattactgtttacgagttgtcccaacagctttggctactgctcttgatataaatctgagcaacatttcacttgttttcattactgtgacatttgctacaatgtgcaaatctgcttctccaattttcattcttctgtttgctttcatgttcaggcttgagaaaccgagctttagccttcttggaatcatgctggttgtttcatttggagttctactaacagttgctaaagagacagaatttaatctatggggatttatgtttatcatgcttgctgctgttatggctggtttccgctggtctatgactcagattcttctccagaaagaggaatatgcattaaagaatccttttaccttgatgagtcatgttgccccggtgatggcaatagtaacagcaattatttccatcgtgatggatccatggcatgacttcagagcaagtcacttttttgatagttctactcacataataagaagcagtttgttgctgcttctaggtggggctttggcctttttcatggttttgacagaatatgtccttgtttctgtgactagcgctgtcacagtgactgtagcaggaattgtgaaggaagctgtcactattctggttgctgtgctattctttaatgatccatttacatggttaaaggcgcttgggctggcaataataatatttggtgtcagtctattcaatatttacaagtataaaaggttcaaaaaagggcatcacagtgaagatgctgggacaaatatccaatcttacaatgggacttcaaagtacgttatccttgatgatgatactgaagatcaggatgattcaggctgacctgaatatggtaggtaagaatgcagactactatatgcactggcgtttccagagaagcaagatcttctggtgcctgcatagacttacttccacaggctaactgatttcatactattttttgagttgatcaaccgctgtggccagtcatgcacgagcgtgacgcttgcagccgtgtgacaagttgagaagactacacgctcgtacatggaacatacaagagacaggctgataatcagtacagatgttttctcctttcgttcaaaacaaagaacggtgcatatatctgaacgaggcattctgcagtatgtccacgaagaaaatgttgcatcaattacaattagaaacacaggtaacacacttaactttatggatgaggatagggttcggttttgtagtgcattctgattgttgaagggagattcagcatcggaacatagctttcttttctttagttctttctttttttgagatgaaaaataaatagtactaacaatcttatatgtaataatgttgtatttacgggaatgtgtaccgtttcacgtaggag

SEQ ID NO: 9652 - DNA, 1125 bp, Zea mays
acagaatggggggtttcgtgaagactcataagtccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtatgagggaaatgttgaggccactggtgaggacttctctgttgagccagctgatgagaggaggcctttccgtgctctcttggatgttggccttatcaggactacaacagggaaccgtgtctttggtgccctcaagggagctttggatgggggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgagtacattaagaagggagttgaggctgaggaaattgaagccctgtacaagaaggtccatgctgccatccgtgccgatccttctgttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtagtgctttctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttctac

SEQ ID NO: 9653 - DNA, 1111 bp, Zea mays
gctgcccacgcccgcagcgcctcgcctcggctgctctacctctatcccgcgacccgcgagatcggaatcgcggcgccccgccgccctcctctaaaatggcgccgtctctgctcggggggttcaccaagtcgttggccatgacggtgctctccgagatcggggacaagaccttcttcgccgccgcgattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatggagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggtggaactgtcaagcggagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatggtgatttaacagtttagccgacacgctgtaaacatttcagtcgcccttcaaaaattactacatgttacagaagtctgtagcgattgtatatttgtattctgtcgtgcccagcacgtgaaattttgttatcgcaattacatgcgttaacaaagctttgtgcgtgaaccaagtattcaggcaattaatatggggcttatagc

SEQ ID NO: 9654 - DNA, 958 bp, Zea mays
gttcgaagctttcagccgagcaccatcgtcacagtcagtagtagctaagcatatttctttctccgagtgatttgcgctgagcgatcagttcatccagagcgagcggagctgagctgagctgagcgagcttgcgtcgttgcttgagagaccctgccatggcttcccaccaggacaaggctagctaccaggccggcgaaaccaaggcccgcaccgagctcgatgtgcaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggccgccaagcagaaggcagccgacgccatggaggccgccaagcagaaggccgccgaggccgggcagtacgccaaggacaccgctgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaaggactcctctaccatcaccagggatcactagacgcgtgtatgcacacgcacttggtccgatcctgtcgtccgtgaccctgtttgcttgttcgcgagtccagtatgggtttgtgcacgttttcagtgtcatggtttccttctctacgaaatttggtgttgtaagtttgattcgcaggtacgttgctgtgttttttctgcgtcatcatgtctgtaaacgagtcgggcgggtttgagtgtcctttgttgtgataataaagttggtaaatcgtaatt

SEQ ID NO: 9655 - DNA, 836 bp, Zea mays
ctcatatcctaaccaggctcactaatccttaccaatcctttcacccaaatcatacataagatagatgttcaatatgtctagggacccattggtcgtcggcaatgttgtgggagatattgtggatcccttcatcacaactgcgtcactgagagtgttctacaacaataaggagatgacaaatggttctgagcttaagccatctcaagtgatgaatgagccaagggtccacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccggggtggagatcaaacttcaacactagagacttcgcagccatctacggccttggctcccctgtcgctgcagtgtacttcaactgccagagagagaacggatgtggtggaagaaggtacataaggtgatatatcaaccaagctatgtgtgcttctctctctctcaagggagagaagcataacaacaaattggagtgaaaaaaatatatatcatgtgtgtggtgaacattgcaagtacgatgttcacaatcataagagccattattggatcacatattattctaatgtaatgtggctgggcgttctattggaaaaatagccacggtttgagatttatatataaatttgtgttgacgaaaattctgat

SEQ ID NO: 9656 - DNA, 1122 bp, Zea mays
ctagcatccgcagttcccccgcgcccgagaagcaaccccgcgccaggagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcactaagtccgtgtggactggtattattcactggatttgagaagcatgtcagtggttgctctagcgttttattgagttttgaagtcatctccct

SEQ ID NO: 9657 - DNA, 1210 bp, Zea mays
gttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcgagaggtgatttagggatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcctatccagagttggcggtgcagactatggctaagatctgcctgcaagcagagtcttgcgtagaccatgctgctattttcaaatcaatcatggcttcagctccaattccaatgagtccattggagagccttgcatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccggtcaatccgttgtggccctgcaccgcatcgggatttcatccgtcatcaagctcctgactgtgaagtaggggtccaagggggagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgtactg

SEQ ID NO: 9658 - DNA, 1031 bp, Zea mays
gcgaattcatgcagggagcaggccggtgaatagcaattccttggcttttcttctaactgttcttgttttgttcatggtactgaactcgcaccagatctctcccaatcttttgctttggcttgtcttgggagtcttcctaatggccacgagcctcagaatgtatgccacgtgccagcagcttgctcatgctgcagctgccaacagttttctcggtcacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcacccccctgcccgaaaaagtgatgggccatctcagctatcagtttcttcaactgggtccggcaatgaggaaaagcaggatggtttaaaagcagatggaaccagcaaaacttcagaggatgaactaacatgtagtgtttgcttagagcaagtcacggtgggtgatctgttgagaagcctaccatgcttgcatcagtttcacgtaaactgcatcgacccatggctgcgccaacagggtacatgcccaatctgcaagcaccaggtgagcgatgggtggcatgctacaggcaacggtgaagaggatgcttcttacatggtgtgagtagctgactaggagtaggccatagctaactactagtagctgctaactgaatccgtggaacatagttttcgaggtgacgggttggactgatctagggatgtgatctaatccctttctatcctaacaaaaccgcgtgtggaaacagttgtccagtacggttcttttacaggtaacgctcatttcaatcattctctgtaatgtaaggcataacaaggttgataatcttcttccccgtcctttcttattatggtcggtttcttttcttttt

SEQ ID NO: 9659 - DNA, 1498 bp, Zea mays
ggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctaatcactcctactgagctctatattttgtaattttcatgtgcattccgattccgctgtgagggtcatgtgagcccgctagagaataattgtaatcttctttgctgcgtctgtacttgtgtttttgtgcgccaggacgtatatttttactgaaatgatactccgaagagcacgtatggtgtcttaccggg

SEQ ID NO: 9660 - DNA, 1548 bp, Zea mays
cgaacagacagcacgcgacgatggaatcatcaagaatggaagggaaatcctatttcaggcttttaactgggaatccaataagcacaactggtggagtattttggaggaaaaagtaaccgatcttgcggaatctgggtttacgtcagtgtggcttcctcctccaacacagtcattatctcgagaaggctatctaccacagaatctgtactgccttgactcatgttatggttccctccatgagctaaaattgttgcttcataaaatgagcgaacataatgtaagggctatggcagatgttgttatcaaccatcgaattggaactactcaaggatccaatggcatgtataatcgttatgatggcatcccaatatcatgggatgaacatgctgttacatcttgttctggcgggaagggaaacaagagcactggggataactttgatggggttcccaatatagatcatacacaaccatttgtacgcaaagatattatcgaatggttgatctcgcttcgaaaatcagttggttttcaagattttcgctttgatttcacgaaaggttatgcagccaagtttgtaaaagaatacattgaggaatcaaaacctctttttgcagttggggaatactgggatagctgtgaatatagcccccctgactaccgactgaactataatcaagatatccataggcagaggattattaattggatagataacactggaggactttgtgccgcatttgatttcacgacaaagggcattcttcaggaagctgtcaaaggagagttgtggcgtttgcgagattcagaaggaaaaccacctggtgtgatgggatggtggccttcaagatcagttacatttattgagaatcatgacactgggtccactcagggtcattggccttttccgtcagatcatattatggagggatatgcttatatactcacccaccctggcatccccacggtgttctatgatcacttctatgaccagggtgtgcctctccatgacgaaattgctaaactgatgcaaatcagaaaatgccaagatatacatagccgttcatcaatcaaaattctggaggttgggtcagatctgtactcagcaatcatcgacgataagttgtgcatgaagatcggggacggctcgtggtgcccaagtgatccagagtggaggctggcagtctctggtgacagatatgctgtgtggcacaagtgaagcatataagtgccctcgatacagtttatttctgctctcaggaacaggagtaattagcatgttagctgaataacagcacggtaaaacatgccaaaaatgaccctcttcgaggttacctgtacaagaggagtgcctaaatgtaatgcttaattagaaatacgtgagatcgggcggctggtcccgaggtgagacatacattttgctaatcgcaacaactatggattacctgcaaaagaaatatatatagggcatgtgatgtctctgtggaatattttataatggaaccagaaatttgaattatttttataaaaaaatgcatctgtgcaatttac

SEQ ID NO: 9661 - DNA, 1131 bp, Zea mays
gttttcacttgacatcccccgtcccatagatcgccggcgatggctccggccgtttccgcggcggcgtcggcggcgatgaggcaggcactgcgggaccggcagatcctcgatgccgtgggcactggcgctgcggcgctctcgctggcaggctcttccttcatcgtgatctgctacctcctcttccgcgagctccgcaagttctccttcaagctcgtcttctacctagccgtctcggatatgttttgcagcttattcactatattgggggggccatcgaatgcattttactgctttgcacatgactacagtgcccatttcttctgtgtggcttcttttctatggacaaccaccatatcattcactctgcatcgcacagttgtaaaacacaaaactgatgttgaagaatttggatctattttccacttatatgtgtggggaacttcactatctaccactgtattacgttcgataggaagtgactatggaagaccaggcacctggtgctggattcagcagggaagcatggcaaaggtcctacatttaataaccttttatcttccactttggggtgccattttgtacaatgggtttacatactatgaagtaaaccgcatgctgaataatgcaacacagatggctgctggcataagtgatcgatcaaatcagtctgacattagggcagacaggaaggcatttaaccgatggggttattaccctctaattctaatcggttcatgggcttttgcaactatcaatcgtctttatgactttgccaatccagggcacaggatagtctggctctcctttcttgatgttgggttcgctggacttatgggcctattcaattccattgcttatgggctaaactcttctgtgcgccgagctatttcagagagaatcgacacgttcctacctgagagaataaaaaggagcctccctgctttgtcaaggctgaggagtcaacaggaaaatgaactcacttctcttatcgttgagggtaactgatatgtaatggattttccatgcacacgaagctttttttttttgtttatctgttcgttcatcaatctccaacaagggaatgcaacatcactgtaggagcagtgggttagtaacacgtcgaattggttc

SEQ ID NO: 9662 - DNA, 1295 bp, Zea mays
ctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatgattaaccttgagatgtgcatgactggtctggacaagaagaaagcttctgtctttttcaagactaatgctgatgggaacacaacatgtgccaaggaaatgacaaagctctctggcatctctgaaatcatccctgagatggagatctgcgattttgacttcgaaccctgtggctactccatgaatgcgatccatggctctgcattctccacaatccatgtgacgcccgaggacggtttcagctatgccagttacgaggttatgggcttggatgccactgctctgtcttatggtgaccttgtcaagagggtcctccggtgctttggcccctcagagttttccgttgccgtgaccatcttcggcgggcgtggccatgctgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 9663 - DNA, 862 bp, Zea mays
gcgcggccgcatcctctccccatcggcagtcttccccaagtcgtctaaaccccaatccctaaatccccgacgcagaccacacgacgcgcacctccgttcacgaggcggaagcatgagtcgccatccgatcactaagtgggcacagaggtccgacagggtgttcttgacaatagagctgcccgacgccaaggatgtgaagcttaacttgaagtctgaaggccatttcaacttctcagctaagggctcagatgacttgccctatgagtttgacattgagctgtttgatgctgtgaatgtggaggagagcaaagcagctgttgccccaaggaccatatgctacctgataaagaaagctaagagcgggtggtggccaaggctgctgaagcaggagggcaagccacctgtgttcttgaaggttgactgggacaaatggcaggacgaggatgatgaagatgctggatttaatgactttggtggtatggacttctcgaaactggacataggaggtgctgatgacgacgatatcggggatgatgaagatgatgtggttgaaagtgctaacaaagatgaacaaggtggtaagacagaagagagcaaggaggaggaagcagctcctgcagctgcagaggaagtgaagccatgaagaatcatttgactttgcttcgcgccatgggtgtccacggtatctagctaggctagacgttccctcggatttttggtgtaaaatctggaggtcgaatcactcactgcctattgaagtaaaggatacaaaaacagttgtgctgtcttagtttttggctgaaccttgtgaactgctgctacaatatttggtcagagtttatatgcatccatcatgcgacgc

SEQ ID NO: 9664 - DNA, 802 bp, Zea mays
cacgatcgagcacacaaccacgaagactcgtttattaggagaaaccacaaaccaccaagccgtgcaagcatcatggagtacggtcagcaggggcagcgcggccacggcgccacgggccatgtcgaccagtacggcaacccagtcgggggcgtcgagcacggcaccggcggcatgaggcacggcacgggaaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctacgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacacgtggctgtgctttgctggcgcgtcaaagccgtaatgttcagtgtttcatagataataagataaacccatgaataagtgtcctacccttgatcatgtgacagggacagggacagtttcctgtacttgtggggtgaatttgtacgtgtgatacggtaactgggtccgtgtactgtttatgctacgttttccatacttaaaagtacgtatatat

SEQ ID NO: 9665 - DNA, 1556 bp, Zea mays
ccgcggactagttttttctgaagattcggcgatggcggtgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgcaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 9666 - DNA, 937 bp, Zea mays
ttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgccctcgcggctcgtgattccaccgccctggttggtggaccatactgggacgtgccacttggccggagagactcgctcggtgcaagcatccaaggctccaacaatgacatcccagcccccaacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcacagctgaggcagggatgcccccgctctggtggtgacaacaacctcttccccttggacttcatcacccctgccaagtttgacaatttttactacaagaacctcctggctggcaagggccttctaagctctgatgagattctgttaaccaagagcgctgagacagcggccctcgtgaaggcatatgctgctgatgtcaatctcttcttccagcactttgcacagtctatggtgaatatgggcaacatctcgccactgacagggtcacaaggtgagatcaggaagaactgcaggaggctcaacaatgaccactgagggcactgaagtcgcttgatgtgctgaattgttcgtgatgttggtggcgtattttgtttaaataagtaagcatggctgtgattttatcatatgatcgatctttggggttttatttaacacattgtaaaatgtgtatctattaataactcaatgtataagatgtgttcattcttcggttgcc

SEQ ID NO: 9667 - DNA, 1099 bp, Zea mays
gtcggtcgaggagtagggttctagcgcctatctccctgcgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaactcggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatggttctcttatgtcatgtgcaattaatgcttcttgtgctgctcttgcatttgctggaatccctatgaaacatcttgctgtcgcgattagctgtggagtgatggacaatggtgtggttatcttagacactagcagagcagaagagcagcaagctaggtcgtttgctcacctggtgtttccgaactcgcgcaagtcagtcgaatcgaaggacccgacacagcgagatgaggagtccgagcgaggattgataacttgcatcacgcatggagcaatgtctgaggatgactatttcaactgcatagagaggggtgtcatggcgtcctcgaggatctcggatttcatgaggaagacactgcagaaggaggtgtccagggatgcctgacctgagtagcaaatgtattagcatgaccgagaagctgaggcgatggcgatggcaatggtgtgtagacagcagctgggtctctagtttagacggcatgtagtcgtgttagaatgaaggaggcaagggtgcggtggagtggaggtcaatcggcgtgtgatgccacgcactagcttagctgcggatggtttggtggacttttgaggaacagataatgagattgtatgcacggcacgctgaaattttacttgaacgccgcccgattaaaacaatatccatactgtacgtgtgtcggtgagctgc

SEQ ID NO: 9668 - DNA, 1028 bp, Zea mays
ggcatggagaaggccacggtgtccgagcccgagaagcacgggcacaaggaggaggagcacgaggtcggcgagaagaaggagggccttttcgccaagctgcaccgcaccagttccagctccagctcgtcgagcgacgaggaagaggaggcgatcgatgagaacggcgagattatcaagaggaagaagaagaaggtgggcctcaaggagaagatcaaggagaagctgccgggccacaaggacggccaccacacggccgcaccgtccccggcgcccgcgcccgtggagacgcatgcccaccaccaggaggaagcgcatcacaggccgcacgtcgtcccggccccggctccggcgcctccaccgcacgtggagacgcacgtccaccagcacgagcacgaccacggcgtcgtcgtccagaaggtcgaggacgacgtgaagaccgggaccccgctgcatgcaccggaggaggagaagaaaggcctgctggacaagatcaaggagaagctccccggtggccacaagaagcctgaagacgctgccgctgccgcaccggctccggccgtccacgcgccggcgccagcgccgcacgccgagaacgtgagcagcccggatggcaaggagaagaagggtttgctgggcaagatcatggacaagatacccggctaccacaagagctcagctgaggaagcagaccacaaggcggacgccgccggcgagcacaggaccagctcctctaattaaggtcgcagtcgcagcgtgtcctggccgtggccgggccttgggcgatcagagaagctagcgttggcatgtgtgttgggttctggattgcttttaccaaaagtttgtttcaaggtggatcgcctggtcaaggtccgtgtgcttttaaggtggatcgcgtgactggcagtgagtgttgctgcttgtgtaggacgtggtacgtacgggctttattttggtcccaagtcaaaagtcacggtcggtctggatgttgtgtacttgggtttgttgaattatgagcagctgcgtgttgt

SEQ ID NO: 9669 - DNA, 1017 bp, Zea mays
gctgttcgaagctttcagccgagcaccatcgtcacagtcagtagccaagcatatttctttctccgagtgatttgcgctgagcgatcagttccagagcgagcggagctgagctgagcgagcttgcgttgcttgagagaccctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggcgaccaagcagaaggccagcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccggtggcgtcatccagcaggccactgagcaggtgaagagcgcggcggcgggcgccaaggacgcggtgatgagcacgctggggatgggcggggacgacaagcagggcgacgccaacaccaacaccaacaccaacaaggactcctctaccatcaccagggatcactagacgcgtgtatgcacacgcacttggtccgatcctgtcgtccgtgaccctgtttgcttgttcgcgagtccagcagtatgggtttgtgcatgttttcagtgtcatggtttccttttctacgaatttggcgttgtaagtttgattcgcaggtacgttgctgtgttttttctgcgtcatcaagtgtctgtaaacgagtcgggcgggtttgagtgtcctttgttgtgataataaagttggtaaatcgtaattaatatatagcatgcgactgtcttgctatggcct

SEQ ID NO: 9670 - DNA, 992 bp, Zea mays
ctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaactgtgtactgtcttatgcggggacctgtagtactgcgataggcatttttgtttaagttttgcgaggtgaacaaaactgtttctgttagtttcgagcttgagctctcaatgtttactctttacattgaaatgctgccgtttggac

SEQ ID NO: 9671 - DNA, 627 bp, Glycine max
cttgctctttctctgtgtcgatggcgggaaaaggagggaaggggcttgtggccggaaaaaccacggcagcgaacaaggacaaagacaaggataagaaaaggcctgtctctcgttcatcccgtgctgggatccagtttcctgtgggtcgtatccataggcagttgaagcaaagggtgcaagcaaatggacgtgtgggggcgactgctgctgtgtacttggcctccattctggaatatctgactgctgaggtgctggagctggcggggaatgctagcaaagatctgaaggtgaagaggatcacaccaaggcacttgcaactcgctatcaggggagacgaagagcttgacaccctcatcaaagggaccattgctggtggtggtgttatccctcacattcacaagtccttgatcaacaaagctgccaaagaatgaaaatcaaatgcctctttgtttctcctattatgtgttcctttatgtttatgtagtagttagtgtagtaggccttctttactgtttatgaacagatgttaatgttattgtgtaaatggtcattctattggcttttaacttgcctgttgtgatacacctgggattgtaatgctgctggattttaagagttctttgtttt

SEQ ID NO: 9672 - DNA, 1054 bp, Glycine max
gaaaaaagccttgactaatagtccataccataattttcctctttcctctgtgcctcgcttcttcttgaatccatgcgcatgagtttgaagaattgtgttagcggtgaggtgagatatttcaatatttgataattgatagtatatatatggggaggggaagagtggatttgaagaggatcgagaacaagatcaataggcaagtgactttctccaagagaaggtctggcttgcttaagaaagcgcgcgagatttctgtgctgtgcgatgctgatgtggctctcatcgtcttctccactaaaggcaagcttttcgactactccaacgaaccttgtatgaaaagaattcttgaacggtatgagaggtattcgtatgcggagagacaacttgctggagatgatcaagcaccaaatgaaaactgggttatagaacacgaaaagctcaaggctagggtggaggtactacagcgaaatcaaaggaattttatgggagaagatctggacagcttaaatcttagaggacttcagagtttggaacaacaacttgattctgctctcaaactcattagatcacgaaagaaccaagccatgaatgaatctatttctgcgcttcagaaaaaggataagtcactccgggaacacaacaacttgctctccaagaagataaaggataaagagaaggagctggccccacaagagcaagatggactgcaaaataacatggatgtgacctctgtccttgtaactcaaccaccggagtccctgacaattggaggcttcccagaagccaaatgtaatgaagaaactccaacgtcgagtcgacctaaaaccattcttcccccttggatgcctcttcctacaaatgaatagaaagcctgttaactcttgttaaatacgaataccacttgtacaaagactagctatatacatcatcaggggcatttgatggtgactataccacctggattgtaatctctgtgtgacgtttctgactgcattttaatgcagctgcaaggtatattaaatgtactacatataaatataaatgatactgatat

SEQ ID NO: 9673 - DNA, 2007 bp, Glycine max
aaaaaaccaactacatcagctcatggcaacccccaaccccaccagattctcccttgccatggagagaaccgggcaatgggttttctccccagaaatccccaccgatgttattgttgcagttggacaaaccaatttttctctccacaagtttattctggcggcgaagagtaactacgtcagaaaagtgataatggaatcagaggagagtgacctaacaagaatagagatttccgacatacctggaggatcagaagcttttgagaaagcggcgaagttctgttacggcgttaacttcgagatcacggttcacaacgtggcggcgctgcactgcgccgctgtgttcctccagatgaccgacgagtattgcgacggaaacctcgccggaaggacggaggattttctctctcaggtcggcctctccacgctccacagcgccgtcgcggttctcaaatcctgccaaaagattctccccttcgccgccgaggtcaacgtcgttgaccgctgcgttgaggtcatcagctgcaaggcttgcaacgaggcgaattttccgagccagtcgccgccgaactggtggacggaagagctcgccgtgctcgacgtggattccttcgcgaaggtgatcgccgcgatgaagcagcgtggcgcgaagtacctaaccgtcgccggagctttgattacgtacaccgaacgcgcgctgagggagctcgtcagggatcactccggcggcggaagaggaatccggtcaccggaatccggagactccgattcggagtcgaaaagaagcgaacagcgcgagcttctgcaggctatcgttcctctctttccgacggagaaagccgcgtttccgatcaacttcctctgctgcctcttgcggtgtgcgatctacctccgcgcgtcgagcgcgtgcaagcgcgagctggagaagcgcgtgacggagattctcgagcacgtgaccgtcgacgacctcctcgtgctcacgttctcctacgacggcgagaggctcttggatctggacagcgtgaggagaattatctccggttttgtggagagggagaagggcacgacggtgttcaacgccggcgtcaacttcaacgaggacttctccgccgcgatgcagcgcgtggccaaaaccgtcgactcgtacctcgctgagatcgccgcgtacgccgaactctccatctcgaaattcaacggcatcgccatcctcattcccaaaggcgcgagaaaatccgacgacgatctataccgcgccgtcgatatctacctcaaggtgcacccgaacctggacgagatagagaaggagaaagtgtgcagtgtattggacacgttaaaactgtcctacgaggcgcgtgtgcacgcgtcgaagaacaagcgtttgccgctacagatcgtgcttcacgcgctgtactacgaccaactacaaataaggagcggtacggcggcggacaagcaagctgtggtggcggcggcggagaaaaaacagctgcaagctgacgtgtccttggtgagggagaacgaggagctgcggtcggagctgatgaagatgaaaatgttcatttccgatttgcagaagaatgttcacggaacgtcgtcgtctgggagggagaatattgggcccactaaaaagcccacgttcttctcgtccatgtccaagaaactgagcaagttgaacccgttcaagaatgggtctaaggacacgtcacacatcgacgatgcccctgtggacttgaccaagcccagaaagagaaggttctccatttcctagatttgctttccttagtcaattccaagctttgtcaaaaagaattttaaattttttgaagtaattacgttttctctcttgattgttaattttttttcatgaaagtgtcaatttgtaattaagaaaaaagtgagacgtgattggatttcttaaattagatttgttcatatctgtatgttaagatgtatttgatctggatatataggaacatcctagtttcaatatgaattaatgagaattataat

SEQ ID NO: 9674 - DNA, 643 bp, Glycine max
cttttaacaatccacacccaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagaccgagagggcttccaaggaacctaaatctccatccaaggctaccaaatctcctaagaaagcttaagtgtttttattttattttatttgaatatgtaaatcagtctttagatgctttttatgtgaaagaaaaaattatctattgcaaacactgtaattcctatcgtctcgcatgtaggagtttgctacattaatgaaatcttctttattttttttgggggtc

SEQ ID NO: 9675 - DNA, 1555 bp, Zea mays
cgtctgcctccccctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgcggcggcaggggacggcaactcgccggaggctggccgctgcctcgacgcgctgcggcggctgcgcgacattcgcgtcaacaccgacatcctcgtctcgacgcaggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggcgaggcccgtgaagattgaaaagaactctgcatcagcaagcatgaagcttgagaaaagagatgtggatgttactggtcagaagcctaacaatgccaaagttgagaagactactagtaatggttccaaagctcaatctgtgaaggtggaaaggatatccaaagaagtcataaggactcctgacgcaaagaggccagcatccgtccccaatggccacccaaagcttacatctcttgtcaaatgcaatgatcctacccgagataaaatccgggaactacttgctgaagcctttgtaagggtttcgagagagactagtgatgatgacagagacgaagtgagaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccaggcataccccccgatgagatggctagcgacgcaaggaagcaagagaacatgcagatcaaggagaaggctctgttcgactgtgagcgtggagcggcaccaaaggcgacgacggaccagttcaagtgtgccagatgtgggcagcggaagacgacctactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaccttttttccccttttttaccccccgtaaactaggagcagttatcctcttcggctcttcctctgtcaggcagcctcctgattcattcagattgtactagtcgaacgcgtgaatgttgttgacttgatcgcatcgtcaccagctgtgaatgttcttgggtggagttagaatagaatggtgccaagtcagacgatgctgatggatt

SEQ ID NO: 9676 - DNA, 1138 bp, Zea mays
cacaaaccgtgtgatggattcatctcttattgattcagagaactctatgcctgggtgtgcatgttctcatcctgaatgttctcctgagaactgtggtcacgtgagtctctttgatggtgtctacaatagcctggtggatatcaatggaacaccaatgcatggcagatttgcatatgatgaagatagtaaaattattttacaggaagggtatccaatatatgagtgcaattcatcatgtatttgtgactcgtcctgccagaataaagtattgcagaaagggctgcttgttaagttggaactctttagaagtgagaataagggttgggctattagggctgctgaacctattctacagggtacctttgtctgcgagtatattggtgaagttgtgaaggctgacaaggctatgaaaaatgcagaaagtgtgtcatcaaagggtgggtgcagttacttgtttagcattgcttcccagattgatagggaaagagttcggactgtaggggctattgaatactttattgatgccacaaggtctggaaatgtttcccgttatattagtcacagttgttccccgaatctcagtacccggttggttttggtagagagcaaagattgccagcttgctcacattggattgtttgctaatcaagatattgccgtaggagaagaactcgcctatgattaccgacaaaagcttgtagcaggcgatggctgcccatgccattgtggaactaccaattgccgaggccgtgtctattgattttgcaggaatacactaactgttcaatgctcggttgcagaactccagagatttcaacagttgtgtaggcttgctgagcgatttagcattgcaattttcctacagcttgagtgcagggctaggatctcattgttaatgctacaaatagtgattgtgatataggactcaggcaagcattaggcaataacatagtgtcgattttagtcatggtaccatcatgtttaactgattatttgttagaagcagcctgaaatgaaactgattcaggctgctctgttcgtaggcgagaattctctctgtaaaattccttcattcatattttatggttcatgagcaccatcattgacgtgaagtaataaactagttatcccagtggcc

SEQ ID NO: 9677 - DNA, 1311 bp, Zea mays
cagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtcccgaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttat

SEQ ID NO: 9678 - protein, 304 aa, Zea mays
MMRETYMDVLPPVDHIAASRSGGWFPGAARLWTAAENKQFERALAGLDLCRPDWEKVARAIPGRTVREVVSHFKSLQVDVQQIESGLVPMPVYGAGAGSFTLQWDGCYGPADSRHNGYRFGSGGCGRRHHGRTPEQDRKKGVPWTEEEHRLFLLGLKKYGKGDWRNISRNYVQTRTPTQVASHAQKYFIRLNSGGKDKRRSSIHDITTVNLTDDERAPSPSRSSLITTTSQPNAPAPAAAVIGGPFSSAAAAEAKQHQHGAGNLPPNRTSVVPAVYRMDDSQDHGLQCGPLRHQLVASHHSVLF

SEQ ID NO: 9679 - protein, 396 aa, Zea mays; identical to SEQ ID NO: 5810
  misc_feature (197)..(197): Xaa can be any naturally occurring amino acid
  misc_feature (210)..(210): Xaa can be any naturally occurring amino acid
  unsure (1)..(396): unsure at all Xaa locations

SEQ ID NO: 9680 - protein, 232 aa, Zea mays
LLRVNSLGYLLHELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 9681 - protein, 286 aa, Zea mays; identical to SEQ ID NO: 4429

SEQ ID NO: 9682 - protein, 306 aa, Zea mays; identical to SEQ ID NO: 6363

SEQ ID NO: 9683 - protein, 334 aa, Zea mays
  misc_feature (258)..(258): Xaa can be any naturally occurring amino acid
  misc_feature (312)..(312): Xaa can be any naturally occurring amino acid
  unsure (1)..(334): unsure at all Xaa locations
MMAEAWTPVPFPPTAPCFWLHDAHSVFWRGGDAWTAAENKLFEKALAQIDRNAPDRWEKVAEVVRTKTVDDVRNHYHDLENDVGFIEAGLVPFPHYSGSVPSFGFTHEDWDGGFRRGYCLKRARGSDPERKKGVPWTEEEHKLFLMGLKKYGRGDWRNISRKYVTTRTPTQVASHAQKYFIRLNSGGKDKRRSSIHDITTVNLPDEDRGNAPPSAVTTTTNPSVALVDMKPFVAPSLGVPHPYGDVKLEPKSSLVAGXLQRLRPPDALRTVVTGCSCGENRSRRNVRHQPPPHLSPGGHQGRRHKSHVVVLXAWMQSCFRCTPTDQMAGTSRRV

SEQ ID NO: 9684 - protein, 157 aa, Zea mays
  misc_feature (133)..(133): Xaa can be any naturally occurring amino acid
  misc_feature (141)..(141): Xaa can be any naturally occurring amino acid
  unsure (1)..(157): unsure at all Xaa locations
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAXRRRPAAAXKEPKSPKKGAKSPKKA

SEQ ID NO: 9685 - protein, 157 aa, Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKA

SEQ ID NO: 9686 - protein, 157 aa, Zea mays; identical to SEQ ID NO: 9684
  misc_feature (133)..(133): Xaa can be any naturally occurring amino acid
  misc_feature (141)..(141): Xaa can be any naturally occurring amino acid
  unsure (1)..(157): unsure at all Xaa locations

SEQ ID NO: 9687 - protein, 405 aa, Zea mays
MVPLCGFCGKQRSMIYCRSDAASLCLSCDRSVHSANALSRRHRRTLLCDRCGLQPASVRCLEDNTSLCQNCDWNGHDAASGASGHKRQAINCYSGCPSSAELSRIWSFIIDIPTVAAEPNCEDGLSMMTIDDSDVTNHHGASDDKRLLEIANTALMSDPPSPDKLKPLIGSSSGDGFDVLPLATDQPAGPVSATPKVPYARDDNKFNDGMYEDLCVDDADLTFENYEELFGTSHIRIEELFDDAGIDSYFEMKETPPFDFNEPKIVQLQCSDVVPADCAMSNTGERADSSLCIPVRQVRSSISHPLSGLTGESSAGDHQDCGVSPILLMGEPPWYSPGPEGSLAGGSRDSALTRYKEKKKKRMFDKKIRYASRKARADVRKRVKGRFIKAGEAYDYDPLSQTRSY

SEQ ID NO: 9688 - protein, 190 aa, Zea mays; identical to SEQ ID NO: 4058

SEQ ID NO: 9689 - protein, 160 aa, Zea mays; identical to SEQ ID NO: 5783

SEQ ID NO: 9690 - protein, 267 aa, Zea mays
MAAGGGGGSAAPFVWKTYTMVEDPGTAGVIGWGSGNNSFVVADPFVFSQTLLPAHFKHNNFSSFVRQLNTYGFRKVHPDRWEFAHASFLRGQTHLLRNIVRRGSSAAGAGGGKRKDASPTELASGDDMTMVATEVVRLKQEQRAIDDRVASMWRRVQETERRPKQMLAFLLKVVGDRDRLHRLVGDAPVPDNGFASGGAAEPPAAEVGEKRARLLLDGDSMVALGPEAVDFAGFYSGGGAFGDVAVDAAAGSRGGGFSFAFGVDAGY

SEQ ID NO: 9691 - protein, 305 aa, Zea mays
MPQRHSKNNNDLAFFTYEEKRKLGYGTQRERLGKDSIKPFDACCLCLKPLIDPLCCPKGHTFCKECILECLLAQKKDIKRKLAAHEAQKKQEKEEEEEKLILQKAKELDAFDQQNHGAVPQYHDRSGSQGKNGFHGANSVKVTSFEEEALRNMKAFWLPSATPEATVKVDAPSTDTVCPEGQEKLKLKSLFPISFMEETADQKRKKAMEKSYMCPSCKSTLTNTMSLVAVSACGHVFCKKCSDKFLVKDKVCLECSKSFKERNLVPLEKGGTGFAAHDERLEARDFKHLGSGSGLGLVKPAPKAY

SEQ ID NO: 9692 - protein, 157 aa, Zea mays; identical to SEQ ID NO: 9684
  misc_feature (133)..(133): Xaa can be any naturally occurring amino acid
  misc_feature (141)..(141): Xaa can be any naturally occurring amino acid
  unsure (1)..(157): unsure at all Xaa locations

SEQ ID NO: 9693 - protein, 160 aa, Zea mays; identical to SEQ ID NO: 5783

SEQ ID NO: 9694 - protein, 166 aa, Zea mays; identical to SEQ ID NO: 5646

SEQ ID NO: 9695 - protein, 250 aa, Zea mays; identical to SEQ ID NO: 4417

SEQ ID NO: 9696 - protein, 119 aa, Zea mays
METDINAPPPPAPAGEGSSAAGSSSSRKPNKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 9697 - protein, 157 aa, Zea mays; identical to SEQ ID NO: 9684
  misc_feature (133)..(133): Xaa can be any naturally occurring amino acid
  misc_feature (141)..(141): Xaa can be any naturally occurring amino acid
  unsure (1)..(157): unsure at all Xaa locations

SEQ ID NO: 9698 - protein, 359 aa, Zea mays; identical to SEQ ID NO: 6361

SEQ ID NO: 9699 - protein, 250 aa, Zea mays
  misc_feature (178)..(178): Xaa can be any naturally occurring amino acid
  unsure (1)..(250): unsure at all Xaa locations
RKNEIKFPQHELIKARVSFLSSFGSVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLXSSFLAVPPSEDQPELIISMDAPHPQVLHASSIELSHYFQFLLKFVLLAYAVLCLTELLHRWSNGSVLSLWSA

SEQ ID NO: 9700 - protein, 327 aa, Zea mays
RRQRGFHRREAIASTYGCPFGEGCHFVHYFPGDYRAVSEMTNLGGATIAPPGGMMMDGPPTPIVKTRLCNKYNTAEGCKWGDRCHFAHGESELGKSMMDNYMPPPIGPPPTGYFAPPPMAPPPMAPPPMAPPPMAPLPMAPPPMAPPPMAPPPMAPPPMAPLPMAPPPMAPPPMAPPPMAPPPMAPLPMAPPPMAPPPMANPGLATPASFGAYATAKISVDASLAGGIIGKGGANIKQISSVTGAKVVIQEDRHESDTSLKNIEFEGTFDQIRNASAMVIELIVSISGIGSNFKTKMCENFAKGSCSYGGKCHFAHGESELRKPAAA

SEQ ID NO: 9701 - protein, 252 aa, Zea mays; identical to SEQ ID NO: 6554

SEQ ID NO: 9702 - protein, 354 aa, Zea mays
MGKKKKRVDKVFCYYCDREFDDEKILVQHQKAKHFKCHVCHKKLSTASGMAIHVLQVHKESVTKVPNAKPDRESTEIEIFGMQGIPAHVLAAHYGEEEDPSTKVPKVEVPQVRPVIMPNSLGMAFPPRPAYGVAPPIYNPALNPLMARPPIWPAAPAQAWYPQQAAYPQQSAVSVPPIVAGLPPQQPLFPIQNVPTPMTSAAANVLQTSFPMAPPGVPSPVAPHVSQPLFPVNTSAVNGAVNSPFLASVAPGTIPASSSAAVGVAGIGYGTNNQGTRDPAVGSSPAVSNNKASGAQPATNEVYLVWDDEAMSMEERRLSLPKYQVHDETSQMNSVDAAIDRRISESRLAGRMAL

SEQ ID NO: 9703 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 9704 - protein, 137 aa, Zea mays; identical to SEQ ID NO: 4110

SEQ ID NO: 9705 - protein, 448 aa, Zea mays; identical to SEQ ID NO: 5993

SEQ ID NO: 9706 - protein, 257 aa, Zea mays
MDSNRSMATSGVAPFVAKTYRMVDDPATDGVVAWGRDNNSFVVADPFAFSQTLLPAHFKHSNFSSFVRQLNTYGFRKVDPDRWEFAHVSFLRGQTHLLGQIVRRSSGGKRKDDGNGAGAGSADDEDAVAMEVVRLRREQRAIEEQVAAMWRRVQETERRPKQMLAFLVKVAGDPQVLRRLVSGAGGDAVFAAAEPEDGASIKRARLLLDAGSGGDGAVDFSGLYSTTAGSEDDGVGFGSDYLQPPPPYVFPVNSGGY

SEQ ID NO: 9707 - protein, 1074 aa, Zea mays; identical to SEQ ID NO: 4590

SEQ ID NO: 9708 - protein, 339 aa, Zea mays
MSSSSSASGVNLTEQIENVFDQLISKIEQADPDFDPRPFLKQLNVLGRYEPIKRNVYFTKRYIEDYGISCHCKPSPGSSVVCGRDCYCSMLFSCCSSQCECDIACTNKSFQHRPLTKTKLIKTEKCGHGLVAEDEIKKGEFVIEYVGEVIDDRTCENRLWTMKRLDDTDFYLCEVSSNMVIDATNKGNLSRFINHSCEPNTAMQKWTVDGETRVGIFALRDIKIGEELTYDYKFVQFGAAQVCHCGSSKCRKMLGTTKYSGSSQNHRTKKKKRKTSCENCIQQFLRLWHPRQKMYVGCWIVDFDQGTKMHTLQFIDHHTEKFDLKEEEWHFLEVDSDED

SEQ ID NO: 9709 - protein, 261 aa, Zea mays; identical to SEQ ID NO: 4116

SEQ ID NO: 9710 - protein, 143 aa, Zea mays; identical to SEQ ID NO: 4785

SEQ ID NO: 9711 - protein, 135 aa, Zea mays
MAGRGKAIGSGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGSAKAAAGDED

SEQ ID NO: 9712 - protein, 257 aa, Zea mays; identical to SEQ ID NO: 6553

SEQ ID NO: 9713 - protein, 426 aa, Glycine max
MEFDAAIPVSREHLPQDAMWQINLRSSETMESEPYPEHPGEPDCSYYIRTGLCRFGATCRFNHPPNRKLAIAAARMKGEFPERIGQPECQYYLKTGTCKFGATCRFHHPRDKAGIAGRVALNILGYPLRPNEPECGYYLRTGQCKFGNTCKFHHPQPNNMVLSMRSSPVYPTVHSPTTPGHQSYATGITNWSSSSYIPSPRWQGPSSYAPLILPQGMVSVSGWSAYSGQMGSDSPQQTMANGQSYGTSRQSEPANSGSQGAYSQFRSGSVPVGFYALQRENIFPERPDQPECQFYMKTGDCKFGAVCRFHHPHERMIPAPDCVLSPIGLPLRPGEPLCVFYSRYGICKFGPSCKFDHPMGVFTYNMSASPLADAPGRRMLGSSSGTSALNLSSEGLVESGSENPRRLSLSETRQIPSGDDNIDEEG

SEQ ID NO: 9714 - protein, 103 aa, Zea mays; identical to SEQ ID NO: 3555

SEQ ID NO: 9715 - protein, 406 aa, Zea mays
RSFNQPISVGMRCRMRYESDDASERRCTGIIIGSREADPIWYGSKWKCLVVRWDDGIECRWPNRVSPWEIELTGSVSGSQMCAPSSKRLKPCLPQVNPEIVLPNGSVSSDFAGSARFHKVLQGQELLGFKTHDGPAISASQATEARNLQYSDERSNNNLGIPRLGVRSPTGIPGFPYHCSGFGESQRFQKVLQGQEVFHPFRGGCLSDGHIRTAGMYQPDGRHVSGAAYKWSAPQGYDFPQPAKPFFLLQESSPSSVMMFPQTRSKITHLEYEYSRHEDGRLDRTVPTQDMGRSNQTLSLWPHLVSGEAIEECTGTVNMHSPVSGAEHESNNESTVENGCKIFGISLAEKIRSCDEADSCSAKCNSRLQPLKSQMPKSLGSCWATVHEQRPVVGRVVDVSATDMMI

SEQ ID NO: 9716 - protein, 322 aa, Zea mays
MGRSPCCDENGLKKGPWTPEEDQKLMEYIQKNGHGSWRALPRLAGLNRCGKSCRLRWTNYLRPDIKRGKFTQEEEQTILQLHSVLGNKWSAIAKHLPGRTDNEIKNFWNTHLKKKLIQMGFDPMTHRPRTDFFAALPQLIALANLRQLVEQRPWDDHAARIQVEAVQAAKLQCLQNLLQSAASITTTPSSSSMNTIPSDLGLLSPPQMSSLSTLPSPSFLESISGQDMVAGQLSDIQIPSSFFEQPTSNEANQQSDFTPKSSVEGENGTPKTLLSENSLPPLADFPISNLGDACGASSCDGSSIQFPSWPELFDEQFMCEFV

SEQ ID NO: 9717 - protein, 298 aa, Zea mays
  misc_feature (40)..(40): Xaa can be any naturally occurring amino acid
  unsure (1)..(298): unsure at all Xaa locations
MVEEGATAAASRSGPAPFLSKTHQMVEEPGTDEVISWAEXGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLKDAARKRARCEEAAASERPIKMIRIGEPWIGVPSSGPGRCGGGN

SEQ ID NO: 9718 - protein, 285 aa, Zea mays; identical to SEQ ID NO: 6385
  misc_feature (123)..(123): Xaa can be any naturally occurring amino acid
  misc_feature (199)..(199): Xaa can be any naturally occurring amino acid
  misc_feature (223)..(223): Xaa can be any naturally occurring amino acid
  unsure (1)..(285): unsure at all Xaa locations

SEQ ID NO: 9719 - protein, 446 aa, Zea mays
CSPLKTKAIGGSVSPFALVIRGGCHFDDKVRNAQNAGFKAAVVYDTEDNGVLVSMAGSSSGVHIYAVFVSKASGEELKKYSGQTDAELWIIPTYENSAWSIMAISFISLLVMSAILAACFFARRHQIRRDRARLPQTREFHGMNSRLVKAMPSLIFTKVQEDDCTSATCAICLEDYSAGEKLRVLPCRHKFHAACVDLWLTSWRTFCPVCKRDANAGTPEPPVSESTPLLSSSAIRLPEPTASVSFRSTVAEAAAASPPRPISRHPSPSRSISRKHSVSGSSIPGTPIPRFHASSSSPTCTSGSSLDLANMSSSPWPRASHLASAHYSCSGRLSPPIHIRNTSAAHVSRSAYGSPSRYVSSSHMSRGSPSCYYLGSSSGQQHPYLRHCTLSGTSLFTMVPQSPQQNQLQHGGDSEKDLSAAAPFRQLYYLQHCPDSGTSSQSLPGC

SEQ ID NO: 9720 - protein, 209 aa, Zea mays; identical to SEQ ID NO: 5710

SEQ ID NO: 9721 - protein, 185 aa, Zea mays; identical to SEQ ID NO: 5100

SEQ ID NO: 9722 - protein, 244 aa, Glycine max
MGRGRVQLKRIENKINRQVTFSKRRSGLLKKAHEISVLCDAEVALIVFSTKGKLFEYSSDPCMERILERYERYSYAERQLVASDQPQTENWTLEHAKLKARLEVLQKNQRNFMGQDLEGLSIKELQNLEHQLDSALKHIRSRKNQIMHESISELHKKDKVLQEQNNTLAKKIKEKEKALAQHAQMEQRGDEMDLTSSALVPHPLETSNIRESSQIRGEGDNEGTPTPTRANAILPSWMLRPSNE

SEQ ID NO: 9723 - protein, 261 aa, Glycine max; identical to SEQ ID NO: 3699

SEQ ID NO: 9724 - protein, 370 aa, Glycine max
MEGVSREAQMSIAASSMFPGFRFCPTDEELISYYLRKKLEGHEESVQVISEVELCKYEPWDLPAKSFIQSDNEWFFFSPRGRKYPNGSQSKRATECGYWKATGKERNVKSGSNIIGTKRTLVFHLGRAPKGERTEWIMHEYCINDKSQESLVICRLKRNTEFRLSDASNRASSSQRHPVNSHESGCAISGGGIDQRDACEQDKEVGCSSKRDSSSYGSPSMEQIDSVSESNQRPVNEATFTESSGQPKEGYEEDCYAEILKDDIIKLDESSVLVESHTRPQDPTQMQPAPQGTAQRRIRLRVGNSKHSRAVVRFPSTMHSSKNTFFARTTNSLVVLAFFVFTLMVLYFLSLVRGQKQDKYCGEFSGVNHD

SEQ ID NO: 9725 - protein, 262 aa, Glycine max; identical to SEQ ID NO: 3838

SEQ ID NO: 9726 - protein, 583 aa, Glycine max
GGHLVYLEIGDGILQEVKHAQLEYEISCLDINPIGENPNHSNLAAVGMWTDISVRIFSLPDLSLITKEQLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTKGRIIVFAVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 9727 - protein, 261 aa, Glycine max
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 9728 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 9729 - protein, 261 aa, Glycine max; identical to SEQ ID NO: 3839

SEQ ID NO: 9730 - protein, 262 aa, Glycine max; identical to SEQ ID NO: 3838

SEQ ID NO: 9731 - protein, 259 aa, Glycine max
MSAEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSASAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPEH

SEQ ID NO: 9732 - protein, 420 aa, Glycine max
  misc_feature (150)..(150): Xaa can be any naturally occurring amino acid
  misc_feature (157)..(157): Xaa can be any naturally occurring amino acid
  unsure (1)..(420): unsure at all Xaa locations
MDKDKSLGLPPPSGRYSGYSSTGSVFNVKSEPSPSSSTTLYPPLAPGTTSSESSHFGHGLSTDSSGFSHDISRMPDNPPRNRGHRRAHSEILTLPDDISFDSDLGVVGGGDGPSFSDDAEEDLLSMYLDMDKFNSSSATSTFQMVEPSNXLWEHRLXPASGAPTSSTENVVIGTNERPRVRHQHSQSMDGSTTIKPEMLVSGSEDMSAADSKKAMSAAKLAELALIDPKRAKRIWANRQSAARSKERKMRYIAELERKVQTLQTEATSLSAQLTLLQRDTNGLNSENNELKLRLQTMEQQVHLQDALNDALKEEIQHLKILTGQAMPPNGGPMMNFASFGGGQQFYPNNHAMHTLLAAQQFQQLQIHPQKQQQHQFQQLQQQQREQHQQSIDLKMREATPTPCPKDNASSDVNPSGAKDC

SEQ ID NO: 9733 - protein, 609 aa, Zea mays
CVLHAVMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 9734 - protein, 175 aa, Glycine max
MKREREVDSLTMANCLMLLSRGSEFEATYSSTSMSNRVFECKTCNRQFPSFQALGGHRASHKKPRLMAGDIEGQLLHDSPPKPKTHECSICGLEFAIGQALGGHMRRHRAANLNGNVHNSTATSSSSGGSSFDSSPKKKADNKRVLVLDLNLTPFENDLEFLKIGKPTTFVDYLY

SEQ ID NO: 9735 - protein, 135 aa, Glycine max; identical to SEQ ID NO: 3868

SEQ ID NO: 9736 - protein, 324 aa, Glycine max
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEGDDDDEDDADDLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQMLRQILKNTTASRRGSNNGTNNAE

SEQ ID NO: 9737 - protein, 262 aa, Glycine max; identical to SEQ ID NO: 3838

SEQ ID NO: 9738 - protein, 261 aa, Glycine max; identical to SEQ ID NO: 3839

SEQ ID NO: 9739 - protein, 261 aa, Glycine max; identical to SEQ ID NO: 9727

SEQ ID NO: 9740 - protein, 404 aa, Glycine max
AIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTKGRIIVFAVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 9741 - protein, 422 aa, Glycine max
  misc_feature (372)..(372): Xaa can be any naturally occurring amino acid
  unsure (1)..(422): unsure at all Xaa locations
RSSTIENSSPCRPNPTSSFSLQYLYPNPPFLNKNKKIKKNPSISWTSMTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNENRREKSLALLTQNFVKLFVCSNFEMISLDEAAKLLLGNANNRTKVRRLYDIANVLSSMNLIEKTHTTNTRKPAFRWLGVRGKTWGGSVDLAQNSNVKESRKRMFGTDIGNISFKRNKVDLSMDGQNSKMQNQHENISPRAQLEKIIIKKDAKQTSESYQFGPFAPAYVPKVGTSENNSXKRCMTGYSLAQEHRPQYQNQALKDLFSHYMVSMVNLGTLKLLGKKSTKTL

SEQ ID NO: 9742 - protein, 241 aa, Glycine max
AERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 9743 - protein, 261 aa, Glycine max; identical to SEQ ID NO: 3839

SEQ ID NO: 9744 - protein, 84 aa, Glycine max; identical to SEQ ID NO: 3909

SEQ ID NO: 9745 - protein, 749 aa, Glycine max
  misc_feature (349)..(349): Xaa can be any naturally occurring amino acid
  misc_feature (355)..(355): Xaa can be any naturally occurring amino acid
  unsure (1)..(749): unsure at all Xaa locations
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFXLILPSXHNQDDYQSFLHMSSTFSNLIVSTLMQNPAAHAAASFAATFWPYANPETSANSPRCSQGGFTNRQIGSPPSVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGSKKCSSNYEAMQKNLLFVENNEGLLTIGLGQGKLKTHRTGFKPYKRCSMEAKENRVGASSNQGEEQGCKRIRLEGETST

SEQ ID NO: 9746 - protein, 285 aa, Glycine max
ASESLSLSLTHTFSLSLSHPDLVAIASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQN

SEQ ID NO: 9747 - protein, 128 aa, Glycine max
MSGKGAKGLITAKDKDKKKPISRSSRAGLQFPVGRIHRLLKSRVTAHGRVGATAAVYSAAILEYLTAEVLELAGNASKDLKVKRITPRHLQLAIRGDEELDTLIKGTIAGGGVIPHIHKSLINKSSKE

SEQ ID NO: 9748 - protein, 206 aa, Glycine max; identical to SEQ ID NO: 3782

SEQ ID NO: 9749 - protein, 459 aa, Glycine max
TLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYGCFIISCSFSDDNNVYYCVGTAYVLPEENEPTKGRIIVFAVEDGKLQLIAEKETKGAVYCLNAFNGKLLAAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 9750 - protein, 234 aa, Glycine max; identical to SEQ ID NO: 4034

SEQ ID NO: 9751 - protein, 339 aa, Glycine max
MGRSPCCDENGLKKGPWTPEEDQKLVQHIQKHGHGSWRALPKLAGLNRCGKSCRLRWTNYLRPDIKRGKFSQEEEQTILHLHSILGNKWSAIATHLPGRTDNEIKNFWNTHLKKKLIQMGFDPMTHQPRTDLVSTLPYLLALANMTDLMDHQTLDEHAIRLQAEAVHLAKLQYLHYLIRSSNSLSTNKSYDQSATTNMEPAAFSLLNSISNVKENPVMLQPADDTPAASLSHGIVSSQPLHPPNVLPHHLLEPQVSFSSQSCLNSEIGQGTNFAIISQGDHTLDLDSSWIIPSITPPNAIGTSANNPGDASSSTSSYGGGPSSYWSELLFEDPILHELS

SEQ ID NO: 9752 - protein, 262 aa, Glycine max; identical to SEQ ID NO: 3838

SEQ ID NO: 9753 - protein, 376 aa, Glycine max
RFQVPSNWLWDLHLEMKDRQRWRAEEDALLRAYVKQYGPREWNLVSQRMNTPLNRDAKSCLERWKNYLKPGIKKGSLTEEEQRLVINLQATHGNKWKKIAAQVPGRTAKRLGKWWEVFKEKQQRETKGNNCTIDPINDSKYEHILESFAEKLVKERPSTSTSTSFVMATSNSSFLHADAPAPAPALLPSWLSNSNGTAPVRPPSPSVTLSLSPSTVAAPPPWMQPPVRGQDNASPLVLGNVAPHGAVLAFGENMVMSELVECCKELDEVHHALAGHKKEAAWRLSRVELQLESEKAGRRREKMEEIEAKIKALREEQTAALDRIEAEYREQLAGLRRDAESKEQKLAEQWAAKHLRLTKFLEQVGCRSRLTEPNGR

SEQ ID NO: 9754 - protein, 234 aa, Glycine max
MVECMKKVAKLDLDLTVEERNLLSVGYKNVIGARRASWRIMSSIEQKEESKGNEHNVKLIKSYCQKVEEELSKICGDILTIIDQHLIPSSASAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPEH

SEQ ID NO: 9755 - protein, 262 aa, Glycine max; identical to SEQ ID NO: 3838

SEQ ID NO: 9756 - protein, 292 aa, Glycine max
MRTPISSDESGLKKGPWSPEEDKILVDFIEKHGHGSWRALPRLAGLNRCGKSCRLRWTNYLRPDIKRGKFSDEEEQLIINLHSVLGNKWAAIASHLPGRTDNEIKNLWNTHLKKKLMQMGLDPVTHRPRTHHLNLLSNLQQILALIRLQSDANKLQLLQNIFEASNSDPLPDSSYSLLNDVLGGLNNLHSNDLHNLYDGNSLSVQNFDQNLNGGRNAEPSPSSNSLPNLVSASPDRSPVVKEAQNILVNSKDFSTSAFELTWGDFMDEEETNQTYWKGFMDQHSNQTWSTFP

SEQ ID NO: 9757 - protein, 678 aa, Glycine max
MQATQGEQSNNASAVHWERFLPRMVLRVLLVEADDSTRQIIAALLRKCGYKVVAFCDGLKAWETLKNKAFDLDLILTEVDLPSISGFSLLTLIMEHDICKNIPVIMMSSHDSVSMVFKCMLKGAADFLIKPVRKNELRNLWQHVWRRHAISRPPQNLTLPEIELGFAAENHAASNDSSGSVASTPKDDECSEKTSEAHSTCPSPFLEAESTYMENMQDILQLKSSSNLSNIDTVKHENSTKCERESDKHNDEAGEKSLFILEDARCNKTFKPTGLRLGQSYECHETRNQDEVLRIELIKSNPEINTDIHRCSDELVDPSTGAIDLIATFKNLPKSTDEKCSFSSGNTAKFDFDTQLELSLRRDFPGSSCKAAFKERQILNHSNASAFSRYSNSKLLQPLFPTPSTISAKLTNASQNSHESLKLSKNTSTSHQYSEKSQNQEEKIITSVIGQSGQVDPKLPNSQLGLFPATGVTSDHKSKGNGNVFPSKLYAKSGVHPISTPKSVCQKESSPFPTSTSSQSNPQSHNSERHHWLEDATHASDQNVNDQSNLECETHDSPAASQSAGPSFFHDTANHNSSGVYRSDGNATSAKVAKESHEIFIDSGQRSYDGFIGTDSHRTSQREAALTKFRLKRKDRCYEKKVRYQSRKRLAEQRPRVKGQFVRQVHDDHPVADVGGGS

SEQ ID NO: 9758 - protein, 149 aa, Glycine max; identical to SEQ ID NO: 3906

SEQ ID NO: 9759 - protein, 244 aa, Glycine max; identical to SEQ ID NO: 3815

SEQ ID NO: 9760 - protein, 261 aa, Glycine max; identical to SEQ ID NO: 3699

SEQ ID NO: 9761 - protein, 134 aa, Zea mays; identical to SEQ ID NO: 4963

SEQ ID NO: 9762 - protein, 278 aa, Zea mays; identical to SEQ ID NO: 6056

SEQ ID NO: 9763 - protein, 137 aa, Zea mays; identical to SEQ ID NO: 4110

SEQ ID NO: 9764 - protein, 307 aa, Glycine max
DMELETIYPPCFMPNSNWFVQESHSTEWTREDNKKFESALAIYDNDTPDRWFKVAAMIPGKTVFDVIKQYRELEEDVSEIEAGRVPIPGYLASSFTFELVDNHNYDGCRRRLAPVRGSDQERKKGVPWTEDEHRRFLMGLLKYGKGDWRNISRNFVVTKTPTQVASHAQKYYIRQKVSGGKDKRRPSIHDITTVNLTETSASDKNKPQLFNASPVLAPQQKLNSISKVQLGWTSSHYNDGSFMVFTPNSDALFVSSSPDVTSMALKMQGQDLYDCALHEAYAKVKVPGFSMAPRDFNNEAVFGIHAL

SEQ ID NO: 9765 - protein, 132 aa, Arabidopsis thaliana
MAGRGKTLGSGSAKKATTRSSKAGLQFPVGRIARFLKKGKYAERVGAGAPVYLAAVLEYLAAEVLELAGNAARDNKKTRIVPRHIQLAVRNDEELSKLLGDVTIANGGVMPNIHNLLLPKKTGASKPSAEDD

SEQ ID NO: 9766 - protein, 613 aa, Glycine max
VVAFCDGLKAWETLKNKPSDIDLILTEVDLPSISGFSLLTLIMEHDICKNIPVIMMSSHDSVSMVLKCMLKGAADFLIKPVRRNELRNLWQHVWRRHAISRPPQNFTLPEIEIGFAAENHAASNDSSGSVASTAKNGECSEKTSEAQDISQLKRSSNLSNIDTVKHENSTKCERESDKHNDEAGEKSLFVSEDSRCNKTFKPTGLRLGQGYECCETRNQDVVLKIELIKSNPEINTDIHGCSDELVDPYTGAIDLIATFKNLPKSTDEKCSFSSGNTAKFDFDTQLELSLRRRDFPGSSCKAASEERQLLNHSNASAFSRYSSSKLLQPLFPTPSTISAKLTNSSLSSHESHKFSENASTSHQYGGKNQNQEKIITPVIGQSGQVDPKLPNSQLGYFPATGVTSDHKSTGNGNVFPSMLYAESGVHPIWTPKSVCQKESSPFPTITSSQSNPQSHNSECHLWSEDSTHASDKNLNDQINLDCETHDSPDASQSAGTSFFHDTANHNSSGVYRSMGCRSDGNATSAKVAKESHGSFIDSGHCSYDGFIGTDSHRTSHREAALTKFRLKRKDRCYEKKVRYQSRKRLAEQRPRVKGQFVRQVQDDHPVADVGGGS

SEQ ID NO: 9767 - protein, 205 aa, Zea mays; identical to SEQ ID NO: 4515

SEQ ID NO: 9768 - protein, 135 aa, Zea mays
MAGRGKAIGSGAAKKAMSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKSGGGSAKAAAGDED

SEQ ID NO: 9769 - protein, 286 aa, Arabidopsis thaliana
  misc_feature (140)..(140): Xaa can be any naturally occurring amino acid
  misc_feature (176)..(176): Xaa can be any naturally occurring amino acid
  unsure (1)..(286): unsure at all Xaa locations
METLHPLLSHVPTSDHRFVVQEMMCLQSSSWTKEENKKFERALAVYADDTPDRWFKVAAMIPGKTISDVMRQYSKLEEDLFDIEAGLVPIPGYRSATPCGFDQVVSPRDFDAYRKLPNGARGFDQDRRKGVPWTEEEHRXKVFNLCDPCFTLLWCLELQVTLFSWFAETLFNCFLXRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEEVMFLGQNLSSVFSS

SEQ ID NO: 9770 - protein, 347 aa, Zea mays
  misc_feature (147)..(147): Xaa can be any naturally occurring amino acid
  misc_feature (154)..(154): Xaa can be any naturally occurring amino acid
  unsure (1)..(347): unsure at all Xaa locations
MAEQAGAGRYWCHMCAAAVSPAEGEVEMKCPFCHSGFLEEMETARGAATDDGDGDGDGAVAQVHPGADRPSSIWAHAILSTVDSSARRRRNRRQQEAASDVYDWNDPEFSLRRRRVTAFLRLLHELRDRQLQRLESAAGVALEGDQXPRSAGAXIGAAGGEHGVALGDYFLGPSLDALVQQLAENDAARHGTPPAKKEAVEAMPTVEIAGGNDGDDAASCPVCLEDYAAGERAREMPCRHRFHGNCIVPWLEMHSSCPVCRFQLPATDDKSSCSGGDGGFVSVDADREGSDNGGGDGRASSPGNAELAEAEESGRRLPPSLQWLNSLFSPSAQSSGSGGSSSHHWEN

SEQ ID NO: 9771 - protein, 204 aa, Zea mays
MSFTGTQDKCKACDKTVHIIDLLTADGVSYHKTCFKCSHCKGVLSISSYSSMDGVLYCKTHFEQLFKETGTFSKNFQGGASSNKNDQAKAPSKLSSAFSGTQDKCAACQKTVYPLEKMTLEGESYHKSCFKCSHGGCILTTSSYAALNGVLYCKIHFSQLFKEKGSYNHLIETAQTKKNEAAEAGPEPPADAGAAEPEAPAQSA

SEQ ID NO: 9772 - protein, 228 aa, Zea mays
MARERREIKRIESAAARQVTFSKRRRGLFKKAEELSVLCDADVALIVFSSTGKLSQFASSSMNEIIDKYSTHSKNLGKAEQPSLDLNLEHSKYANLNEQLVEASLRLRQMRGEELEGLSVEELQQLEKNLESGLHRVLQTKDQQFLEQISDLEQKSTQLAEENRQLRNQVSHIPPVGKQSVADAENVIAEDGQSSESVMTALHSGSSQDNDDGSDVSLKLGLPCVAWK

SEQ ID NO: 9773 - protein, 519 aa, Arabidopsis thaliana
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 9774 - protein, 131 aa, Arabidopsis thaliana
MAGRGKQLGSGAAKKSTSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGSSKPTEED

SEQ ID NO: 9775 - protein, 103 aa, Arabidopsis thaliana
  misc_feature (7)..(7): Xaa can be any naturally occurring amino acid
  unsure (1)..(103): unsure at all Xaa locations
MSGKRKXGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 9776 - protein, 212 aa, Arabidopsis thaliana
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 9777 - protein, 352 aa, Arabidopsis thaliana
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 9778 - protein, 352 aa, Arabidopsis thaliana
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 9779 - protein, 248 aa, Arabidopsis thaliana
MKIQCDVCEKAPATVICCADEAALCPQCDIEIHAANKLASKHQRLHLNSLSTKFPRCDICQEKAAFIFCVEDRALLCRDCDESIHVANSRSANHQRFLATGIKVALTSTICSKEIEKNQPEPSNNQQKANQIPAKSTSQQQQQPSSATPLPWAVDDFFHFSDIESTDKKGQLDLGAGELDWFSDMGFFGDQINDKALPAAEVPELSVSHLGHVHSYKPMKSNVSHKKPRFETRYDDDDEEHFIVPDLG

SEQ ID NO: 9780 - protein, 267 aa, Arabidopsis thaliana
MATPGASSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWTSDMQDDVADDIKEAAPAAAKPADEQQS

SEQ ID NO: 9781 - protein, 350 aa, Glycine max; identical to SEQ ID NO: 4030

SEQ ID NO: 9782 - protein, 259 aa, Glycine max
MSVEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSGSAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDNIKAEEAKPSEPEH

SEQ ID NO: 9783 - protein, 103 aa, Glycine max; identical to SEQ ID NO: 3555

SEQ ID NO: 9784 - protein, 215 aa, Glycine max
EKTTEGKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 9785 - protein, 135 aa, Glycine max; identical to SEQ ID NO: 3868

SEQ ID NO: 9786 - protein, 149 aa, Glycine max; identical to SEQ ID NO: 3905

SEQ ID NO: 9787 - protein, 134 aa, Glycine max; identical to SEQ ID NO: 3943

SEQ ID NO: 9788 - protein, 103 aa, Glycine max; identical to SEQ ID NO: 3555

SEQ ID NO: 9789 - protein, 259 aa, Glycine max
MAAAPSPREENVYMAKLAEQAERYEEMVEFMEKVSAAADNEELTVEERNLLSVAYKNVIGARRASWRIISSIEQKEESRGNEDHVSVIRDYRSKIESELSNICDGILKLLDSRLIPSASSGDSKVFYLKMKGDYHRYLAEFKTGAERKEAAESTLSAYKAAQDIANAELPPTHPIRLGLALNFSVFYYEILNSPDRACNLAKQAFDEAIAELDTLGEESYKDSTLIMQLLRDNLTLWTSDMQDDGADEIKEAAPKQDDQ

SEQ ID NO: 9790 - protein, 136 aa, Glycine max
MAGKGGKGLLAAKTTAANKDKDKDKKRPISRSSRAGIQFPVGRIHRQLKQRVQANGRVGATAAVYLASILEYLTAEVLELAGNASKDLKVKRITPRHLQLAIRGDEELDTLIKGTIAGGGVIPHIHKSLINKTAKD

SEQ ID NO: 9791 - protein, 300 aa, Glycine max
MAPPLEHNGVSTSGDSQRSIPTPFLTKTYQLVDDHTIDDVISWNDSGSSFIVWNTTAFAKDLLPKYFKHNNFSSFVRQLNTYGFRKVVPDRWEFSNEYFRRGEKRLLCEIQRRKILSASPPPAGATATVAVPSPLPLSAIPTAKPIVSPSNSAEEQVLSSNSSPARAPVELLDENERLRKENILLTKELVKMRSLCNNIFNLMSNYANAQADGSSAAAAKRCSGEDAVEEMNPKLFGVAIGKKRAREEEGHGAKYDTALSLHQPFHADVKSEALDLPGRGENKKTPWLNQCHRANQRVCN

SEQ ID NO: 9792 - protein, 136 aa, Glycine max; identical to SEQ ID NO: 9790

SEQ ID NO: 9793 - protein, 124 aa, Glycine max; identical to SEQ ID NO: 3609

SEQ ID NO: 9794 - protein, 84 aa, Glycine max; identical to SEQ ID NO: 3974

SEQ ID NO: 9795 - protein, 286 aa, Glycine max
KIDTDSWEFANENFVRGQKHLLKNIHRRKHPHSADQQKALPQQDNCDEPSQEAPNHGLWKEVENLKLDKNSLTQELVKLRQHQESAESKLLLLSDRLQGMEKHQQQMLSFLVMVVQSPGFMVQLLHPKENNWRLAESWNRLDQDKQDDKPVASDGMIIKYKPPVGEKLKPVVPLSPGFENQPEPELSADGLKDLCISSEFLKVLLDEKLSPLENHSPFLLPDLPDDGSWEQLFLGSPFLGNIQDSKNESEGHTNSGMEMEPTISETPNENSRTFESMIVEMEKTRE

SEQ ID NO: 9796 - protein, 279 aa, Glycine max; identical to SEQ ID NO: 3653

SEQ ID NO: 9797 - protein, 632 aa, Zea mays
INDLLIQVTANSVRLVSCTSRELVNQWNAPAGFSVNVASANASQVLLATGGGHLVYLEIRDAKLVEVKHAQLEHEISCLDLNPIGENPQYSSLAAVGMWTDISVRIFSLPDLELIRKENLGGEIVPRSVLLCTLEGVSYLLCALGDGNLFSFLLNASTGELTDRKKVTLGTQPISLRTFSSKGTTHVFASSDRPTVIYSSNKKLLYSNVNLKEVNHMCPFNTAAFPDSLAIAKEGELSIGTIDDIQKLHIRTIPLNEQARRICHQEQSRTLAFCSFKYNQSVEESETHLIRLLDHQTFESLCVYPLDQYECGCSIISCSFADDSNVYYCVGTAYVIPEENEPTKGRILVFAVEDGSLQLIVEKETKGAVYSLNAFNGKLLAAINQKIQLYKWMSREDGSHELQSECGHHGHILALYTQTRGDFIVVGDLMKSISLLVYKHEESAIEERARDYNANWMTAVEMLDDEVYVGAENSYNLFTVRKNSDAATDDERARLEVVGEYHLGEFVNRFRHGSLVMRLPDSDIGQIPTVIFGTINGVIGIIASLPHDQYIFLEKLQSTLVKYIKGVGNLSHEQWRSFHNDKKTAEARNFLDGDLIESFLDLSRSKMEEVSKAMGVPVEELSKRVEELTRLH

SEQ ID NO: 9798 - protein, 206 aa, Zea mays; identical to SEQ ID NO: 4513

SEQ ID NO: 9799 - protein, 223 aa, Zea mays
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKRNLQSPPEAPPDLNRCVPPWPRSLPAPSNDMDVETELYIGLPGRERSSNRDSD

SEQ ID NO: 9800 - protein, 261 aa, Zea mays; identical to SEQ ID NO: 4116

SEQ ID NO: 9801 - protein, 256 aa, Zea mays; identical to SEQ ID NO: 6523

SEQ ID NO: 9802 - protein, 202 aa, Zea mays
MQVPYQQCHSNGFLHGGINYPGNRLQLGPRNPVLFTSSERAFGPPQHPFLANPVNHRNIRILPPEHATIMDFSRLYEVSNTVDEHRDMRLDIDSMTYEELLALEEQIGDVNTGLTKSHIVDKLRTSLYVPGISSMSDQPSKSSLENDACIICQEEYQARDCVGTLDCGHRYHAECVKQWLMVKNLCPICKTTALSANRRQGQ

SEQ ID NO: 9803 - protein, 226 aa, Zea mays
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTTSSSSAAVVVGSFVKVSMDGAPYLRKVDLRMYRGYRELREALEALFVSSSSANNLSEFAVTYEDKDGDLMLVGDVPFEMFASTCKKLRIMKRSEATGLGSSSARQQ

SEQ ID NO: 9804 - protein, 230 aa, Zea mays; identical to SEQ ID NO: 4904

SEQ ID NO: 9805 - protein, 137 aa, Zea mays; identical to SEQ ID NO: 4110

SEQ ID NO: 9806 - protein, 301 aa, Zea mays
  misc_feature (157)..(157): Xaa can be any naturally occurring amino acid
  misc_feature (173)..(173): Xaa can be any naturally occurring amino acid
  unsure (1)..(301): unsure at all Xaa locations
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDXATAPARFTAPWRGPVXEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 9807 - protein, 244 aa, Zea mays; identical to SEQ ID NO: 4365

SEQ ID NO: 9808 - protein, 251 aa, Zea mays; identical to SEQ ID NO: 4491

SEQ ID NO: 9809 - protein, 204 aa, Zea mays
MSFTGTQDKCKACDKTVHIIDLLTADGVSYHKTCFKCSHCKGVLSISSYSSMDGVLYCKTHFEQLFKETGTFSKNFQGGASSNKNDPAKAPSKLSSAFSGTQDKCAACQKTVYPLEKMTLEGESYHKSCFKCSHGGCILTTSSYAALNGVLYCKIHFSQLFKEKGSYNHLIETAQTKKNEAAEAGPEPPADAGAGEPEAPAQSA

SEQ ID NO: 9810 - protein, 307 aa, Zea mays
MEGTAAARKRSRPETANGAAAAGKRSKDTESFQTGLSSKSKPCTKFFSTIGCPFGEGCHFLHFVPGGYAAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAA

SEQ ID NO: 9811 - protein, 261 aa, Glycine max; identical to SEQ ID NO: 3839

SEQ ID NO: 9812 - protein, 300 aa, Glycine max; identical to SEQ ID NO: 9791

SEQ ID NO: 9813 - protein, 103 aa, Glycine max; identical to SEQ ID NO: 3555

SEQ ID NO: 9814 - protein, 486 aa, Glycine max
MLDLNLNAEWTDSFSNGESPLPLEKFPDGLRNQMAESGTSNSSVVNADGSSNGGGDEDSDSTRAADDVYTTFNFDILKVEGANGFVTKELFPVMSEGAKGHATSSFSGTNGFVDLSFDGDGGNTSEMKMLQPQNQNQTQTRTQTQQPAKKSRRGPRSRSSQYRGVTFYRRTGRWESHIWDCGKQVYLGGFDTAHAAARAYDRAAIKFRGVDADINFNLSDYEDDLKQMQNLSKEEFVHILRRQSTGFSRGSSKYRGVTLHKCGRWEARMGQFLGKKYIYLGLFDSEVEAARAYDKAAIKCNGREAVTNFEPSTYEGELKSAAINEGGSQNLDLNLGIATPGPPKENWGQLQFPSFPYNTHGGRSSMMETNVSSGIGNPSLKRMVATEDRPSLWNGMSPNFFPNGERAERIGVDPSNGLPNWAWQTHGQVNATPVPTFSAAASSGFSISATFPSAAIFPTSSMNSIPQSLCFTSSSMPTRNASEYYY

SEQ ID NO: 9815 - protein, 148 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTQVAKEPKSPSKATKSPKKA

SEQ ID NO: 9816 - protein, 103 aa, Glycine max; identical to SEQ ID NO: 3555

SEQ ID NO: 9817 - protein, 103 aa, Glycine max; identical to SEQ ID NO: 3555

SEQ ID NO: 9818 - protein, 149 aa, Glycine max; identical to SEQ ID NO: 3906

SEQ ID NO: 9819 - protein, 288 aa, Glycine max
MRLDSTANCYLQLEAPQPQENNNVTDSSSDMSDRIIKIQIANHPLYPDLLSAYIECQKVGAPPELACLLEEIGRESHRMNARREIGEGPELDHFMETFCQVLHRYKEELSRPFNEATLFLGDMESQLSNLCNETLTKSSDNNNRSDEVASGASEEELSCGEMEAFEDNVSSVTCPSDQRLKEMLLRKYSGHFSGLRKEFLKRRKKGKLPKDARMALMGWWNTHHRWPYPTEEEKVKLSEITGLDQKQINNWFINQRKRHWKPTEDMRFAVMDGLRGGGGGGIGGPMLF

SEQ ID NO: 9820 - protein, 324 aa, Glycine max
MERSGGMVTGSHERNELVRVRHGSDSRSKPLKNLNGQSCQICGDTIGLTATGDVFVACHECGFPLCHSCYEYELKHMSQSCPQCKTAFTSHQEGAEVEGDDDDEDDADDLDNEINYGQGNSSKAGMLWEEDADLSSSSGHDSQIPNPHLANGQPMSGEFPCATSDAQSMQTTSIGQSEKVHSLSYADPKQPGPESDEEIRRVPEIGGESAGTSASQPDAGSNAGTERVQGTGEGQKKRGRSPADKESKRLKRLLRNRVSAQQARERKKAYLIDLETRVKDLEKKNSELKERLSTLQNENQTLRQILKNTTASRRGSNNGTNNAE

SEQ ID NO: 9821 - protein, 266 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRTYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 9822 - protein, 135 aa, Glycine max
SGKGAKGLITGKTSASAKDKDKDKKKPVSRSSRAGLQFPVGRIHRLLKSRVSANGRVGATAAVYSAAILEYLTAEVLELAGNASKDLKVKRITPRHLQLAIRGDEELDTLIKGTIAGGGVIPHIHKSLINKSSKE

SEQ ID NO: 9823 - protein, 261 aa, Glycine max; identical to SEQ ID NO: 3839

SEQ ID NO: 9824 - protein, 255 aa, Zea mays
MFPPGLIHHRPDATAPGDGPPRSGPGGPSLVLTADPKPRLRWTADLHERFVDAVAQLGGPEKATPKTILRTMGVKGLTLFHLKSHLQKYRLGKQSGKEGSEQSKDASYLLDAQSGMSVSPRVAAQDMKESQEVKEALRAQMEVQRRLHEQVEVQKRVQIRMEALEKYIDSILESACKMVTEQFASSGFSISNPDLPEISPGGVMCGSTDTLGSSVLNQLSVSSIDSHSPGGKPSPSGMEGPTLLQKSPELKRRSS

SEQ ID NO: 9825 - protein, 137 aa, Zea mays; identical to SEQ ID NO: 4110

SEQ ID NO: 9826 - protein, 378 aa, Zea mays
MDVDRTGGLELPPGFRFHPSDFEIVNDYLTKKVHDRDYSCIAIADADLNKTEPWDLPKVAKMGEKEWYFFYQKDRKYPTGLRANRATEAGYWKATGKDKEVYDPLAAEGLLLVGMKKTLVFYKGRAPRGDKTNWVMHEYRLEGSGRLPASPASASGSATNIAAAMMKASASACKDEWVVCRVFNKTTGIKKTAAPAYQVAMAGAEMDQNQNNIPAIPIPMPLQLPLPVPMQMQFPILPDFAMDPVAPYYPNPNAGAGMMPPMALAGMGGAGGLQINGALFGNPVPAPLPMNFYHHQMGMGAAAGQVDMGAAAGQMDMGAAGAGAGGFDVAAPESRPSSMVSQKDEQANAAEISSMMSVTGPGSATTTIEMDGIWKYKY

SEQ ID NO: 9827 - protein, 284 aa, Zea mays
  misc_feature (44)..(44): Xaa can be any naturally occurring amino acid
  unsure (1)..(284): unsure at all Xaa locations
SPSSREQPCQGTTAPRATSPSPDASRPAPSQHASQRYVPSRSTXKVRRHYELLVEDVDGIESGRVPLPAYAADGAAEEGGGGGKKGSGGGGTHGDKGSAKSAEQERRKGIAWTEDEHRLFLLGLEKYGKGDWRSISRNFVISRTPTQVASHAQKYFIRLNSMNRERRRSSIHDITSVNNGDPSTAQGPITGQTNGQAANPGKPSKQSPQPANTPPGVDAYGTTIGQPVGGPLVSAVGTPVTLPVSAPPHLAYGMRAPVPGAVVPGAPVNIAPMPYPMPPPPSHG

SEQ ID NO: 9828 - protein, 234 aa, Zea mays
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALF

SEQ ID NO: 9829 - protein, 553 aa, Zea mays
VHMPDMDGFKLLELVGLEMDLPVIMLSANGETQTVMKGITHGACDYLLKPVRIEQLRTIWQHVVRRRSCDAKNSGNDNDDSGKKLQVVSAEGDNGGVNRNKRISRKGRDDNGDDGDDSDDNSNENGDSSSQKKPRVVWSVELHRKFVAAVNQLGIDKAVPKKILDLMNVENITRENVASHLQKYRLYLKRLSADASRQANLTAAFGGRNPAYVNMGLDAFRQYNAYGRYRPVPTTNHSQPNNLLARMNSPAFGMHGLLPSQPLQIGHNQNNLSTSLGNVGGMNNGNLIRGAHMPLQDTSKCFPTGPSGNSFANISNSTQLVTTNNLPLQSLEPSNQQHLGRLHSSADPFNSFVGEPPQFADLGRCNTTWPTAVSSSNVQEIGQKDRIVNRPKLEPLSSFTEASSQIPLLGSEMQSHQVASLASNGLPMPFTQEAVPFAYGSSTNSREMLNNNLALSNSGVNSTLPNLRIDGSVVPGQTLGGSNSGGCVVPPLQDGRIDHQAVSSHLNYNNELMGTGRLQRGLSGGLDDIVVDMFRPDRADDGVSFIDGDWELV

SEQ ID NO: 9830 - protein, 215 aa, Glycine max; identical to SEQ ID NO: 9784

SEQ ID NO: 9831 - protein, 103 aa, Glycine max; identical to SEQ ID NO: 3555

SEQ ID NO: 9832 - protein, 134 aa, Glycine max; identical to SEQ ID NO: 3792

SEQ ID NO: 9833 - protein, 350 aa, Glycine max; identical to SEQ ID NO: 4031

SEQ ID NO: 9834 - protein, 136 aa, Arabidopsis thaliana
MAGKGGKGLVAAKTMAANKDKDKDKKKPISRSARAGIQFPVGRIHRQLKTRVSAHGRVGATAAVYTASILEYLTAEVLELAGNASKDLKVKRITPRHLQLAIRGDEELDTLIKGTIAGGGVIPHIHKSLINKTTKE

SEQ ID NO: 9835 - protein, 498 aa, Arabidopsis thaliana
MATNYNEKLLLNYVPVYVMLPLGVVNVENVFADPETLETQLKRLKEEAGVDGVMVDVWWGIIESKGPKQYDWTAYKTLFQLIARLGLKIQAIMSFHQCGGNVGDIVTIPIPQWVRDVGDNDPDIYYTNRKGTRDIEYLSIGVDNLPLFAGRTAVQLYSDYMSSFKENMADLIEAGVIVDIEVGLGPAGELRYPSYPQSQGWVFPGIGEFQCYDKYLKKDFKEAAAKAGHPEWDLPEDAGEYNDKPEETGFFKKDGTYVSEKGKFFMTWYSNKLIFHGDQILGEANKIFAGLKVNLAAKVSGIHWLYNHHSHAAELTAGYYNLFKRDGYRPIARMLSKHYGILNFTCLEMKDTDNTAEALSAPQELVQEVLSKAWKEGIEVAGENALETYGAKGYNQILLNARPNGVNPNGKPKLRMYGFTYLRLSDTVFQENNFELFKKLVRKMHADQDYCGDAAKYGHEIVPLKTSNSQLTLEDIADAAQPSGAFKWDSETDLKVDG

SEQ ID NO: 9836 - protein, 248 aa, Arabidopsis thaliana
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 9837 - protein, 267 aa, Arabidopsis thaliana; identical to SEQ ID NO: 9780

SEQ ID NO: 9838 - protein, 303 aa, Arabidopsis thaliana
VGTAYVLPEENEPTKGRILVFIVEEGRLQLITEKETKGAVYSLNAFNGKLLASINQKIQLYKWMLRDDGTRELQSECGHHGHILALYVQTRGDFIAVGDLMKSISLLIYKHEEGAIEERARDYNANWMTAVEILNDDIYLGTDNCFNIFTVKKNNEGATDEERARMEVVGEYHIGEFVNRFRHGSLVMKLPDSDIGQIPTVIFGTVSGMIGVIASLPQEQYAFLEKLQTSLRKVIKGVGGLSHEQWRSFNNEKRTAEAKGYLDGDLIESFLDLSRGKMEEISKGMDVQVEELCKRVEELTRLH

SEQ ID NO: 9839 - protein, 267 aa, Arabidopsis thaliana
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEEQKEI

SEQ ID NO: 9840 - protein, 267 aa, Arabidopsis thaliana; identical to SEQ ID NO: 9839

SEQ ID NO: 9841 - protein, 132 aa, Arabidopsis thaliana
MAGRGKTLGSGVAKKSTSRSSKAGLQFPVGRIARFLKNGKYATRVGAGAPVYLAAVLEYLAAEVLELAGNAARDNKKTRIVPRHIQLAVRNDEELSKLLGDVTIANGGVMPNIHSLLLPKKAGASKPSADED

SEQ ID NO: 9842 - protein, 259 aa, Arabidopsis thaliana
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 9843 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGKIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 9844 - protein, 271 aa, Arabidopsis thaliana
MGRGKIEIKRIENANSRQVTFSKRRSGLLKKARELSVLCDAEVAVIVFSKSGKLFEYSSTGMKQTLSRYGNHQSSSASKAENLQEDCAEVDILKDQLSKLQEKHLQLQGKGLNPLTFKELQSLEQQLYHALITVRERKERLLTNQLEESRLKEQRAELENETLRRQVQELRSFLPSFTHYVPSYIKCFAIDPKNALINHDSKCSLQNTDSDTTLQLGLPGEAHDRRTNEGERESPSSDSVTTNTSSETAERGDQSSLANSPPEAKRQRFSV

SEQ ID NO: 9845 - protein, 268 aa, Zea mays
MSPSEPTREESVYMAKLAEQAERYEEMVEFMERVARYAGGAGGGEELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQ

SEQ ID NO: 9846 - protein, 230 aa, Zea mays
EKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 9847 - protein, 300 aa, Glycine max; identical to SEQ ID NO: 3856

SEQ ID NO: 9848 - protein, 686 aa, Zea mays; identical to SEQ ID NO: 5578

SEQ ID NO: 9849 - protein, 220 aa, Zea mays
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 9850 - protein, 455 aa, Zea mays
  misc_feature (140)..(140): Xaa can be any naturally occurring amino acid
  misc_feature (154)..(154): Xaa can be any naturally occurring amino acid
  unsure (1)..(455): unsure at all Xaa locations
MPNLPAGFRFHPTDEELMVHYLMRQAASMPCPVPIIAEVNIYQCNPWDLPAKALFGDKEWFFFSPRDRKYPNGARPNRAAGSGYWKATGTDKAILSSSTPTSHGGANIVVGVKKALVFYGGRPPKGTKTDWIMHEYRLSXRRTTTARAAPGAEXSSSSSSMRLDDWVLCRIHKKSNDFQLSSSSEHEHEQEEPAAGGSATTVEELDALVVVDNSSSSDTTTTTITTNDNNSTETAATHHDPQTMMMLSKSCSLTDLLDSIDYAALSSQMLLLDAPHPHADDPPPHMVYYPPAASATHQQAIIANNTNSNDDYYDDDNLLPTAAATAVDAAAAAVLLSSSPADTNGVNKRKRVTAVDYYGAAEPPTFFHHHLDDGGNSFFSTTKKLKPPPPSDSRHGGHFGTATASSYRDSQQLVDSASSSGVFFHQYGYGYSSSNPFLNLNQQQQLLLNSHIGMQ

SEQ ID NO: 9851 - protein, 235 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 9852 - protein, 199 aa, Zea mays
MAEEEAKKVEVEVTKEPEAAAKEDVADDKAVIPASDPPPPPPPADDSKALAIVEKVADEPAPEKPAPAKQGGSNDRDLALARVETEKRNSLIKAWEENEKTKAENKAAKKVSAILSWENTKKANIEAELKKIEEQLEKKKAEYAEKMKNKVAMIHKEAEEKRAMVEAKRGEEVLKAEEMAAKYRATGHAPKKLIGCFGA

SEQ ID NO: 9853 - protein, 256 aa, Zea mays; identical to SEQ ID NO: 9703

SEQ ID NO: 9854 - protein, 260 aa, Zea mays
  misc_feature (167)..(167): Xaa can be any naturally occurring amino acid
  misc_feature (183)..(183): Xaa can be any naturally occurring amino acid
  misc_feature (196)..(196): Xaa can be any naturally occurring amino acid
  unsure (1)..(260): unsure at all Xaa locations
MSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQXDHGVHVDRMKVYISYXVIHSFWGFFWGVXDIALADLAPTHPIRLGLALNFSVFYYEILNSPDRACNLAKQVCFFSFYPHFVICFHFETLCDLF

SEQ ID NO: 9855 - protein, 137 aa, Zea mays; identical to SEQ ID NO: 4110

SEQ ID NO: 9856 - protein, 249 aa, Arabidopsis thaliana
  misc_feature (160)..(160): Xaa can be any naturally occurring amino acid
  unsure (1)..(249): unsure at all Xaa locations
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPXAKKVCVVSQSESELSQPSFPVECIGFGNGDEFQNLNYGFEPDYDLKQQISSLESFLELDGNTAEQPSQLDESVSEVDMWMLDDVIASYE

SEQ ID NO: 9857 - protein, 371 aa, Glycine max; identical to SEQ ID NO: 3987

SEQ ID NO: 9858 - protein, 248 aa, Arabidopsis thaliana; identical to SEQ ID NO: 9836

SEQ ID NO: 9859 - protein, 148 aa, Glycine max; identical to SEQ ID NO: 9815

SEQ ID NO: 9860 - protein, 261 aa, Zea mays; identical to SEQ ID NO: 4116

SEQ ID NO: 9861 - protein, 261 aa, Zea mays; identical to SEQ ID NO: 4116

SEQ ID NO: 9862 - protein, 268 aa, Zea mays
MSPSEPTREESVYMAKLAEQAERYEEMVEFMERVARYAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQ

SEQ ID NO: 9863 - protein, 213 aa, Zea mays
NLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 9864 - protein, 222 aa, Zea mays
  misc_feature (207)..(207): Xaa can be any naturally occurring amino acid
  unsure (1)..(222): unsure at all Xaa locations
MGRSPCCEKIGLKKGPWTPEEDQKLLAYIQEHGHGSWRALPVKAGLQRCGKSCRLRWTNYLRPDIKRGKFSLQEEQTIIQLHALLGNRWSAIATHLPNRTDNEIKNYWNTHLKKRLAKMGIDPVTHKSISGTRIGTTNDKSTKAAASLSHMAQWESARLEAEARLARESKIRTATPTPTALHAQPTILPASAASPCLDVLHAWQGAXDRPGVSNLHADVYRE

SEQ ID NO: 9865 - protein, 274 aa, Zea mays
SSSSSEVPIAARTCVSVGEVAVGAVATGSGDRVAADCGVCAICLDRIALQETALVKGCDHAYCVTCILRWASYKENPLCPQCKHPFEFLSVHRSLDGCLHDYLFEESVCLLLRAAWFEPLIVEAHEEALEEEEFLHQQYQYDDDEDDLDEESYYMNRSPSIRIGNRRWGDNGYIRGGRKEARPVNTDVAAGPSRTPKKKEKAASSSASVSVSGSGSGSGSVSKDVAGRRAKRAQKREAADKAAAEKHLKHLQRLGLRKSPEPVVPEEVGPQVNE

SEQ ID NO: 9866 - protein, 277 aa, Zea mays
MEHSNTQSGAAKVSILMIGQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLLLMYSFWVPQIVTNVIRDTRKPLHPQYILGMTVTRLAIPLYIFGCPSNFMRIEPDKKWSIAVTVFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 9867 - protein, 306 aa, Zea mays; identical to SEQ ID NO: 6486

SEQ ID NO: 9868 - protein, 266 aa, Zea mays
MSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQ

SEQ ID NO: 9869 - protein, 245 aa, Zea mays; identical to SEQ ID NO: 6337

SEQ ID NO: 9870 - protein, 194 aa, Zea mays
YFFCSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQPRGGAESESEPSPAPAQANRGNLPPWMLRTVK

SEQ ID NO: 9871 - protein, 245 aa, Zea mays
MGRGKVQLKRIENKINRQVTFSKRRSGLLKKAHEISVLCDAEVALIIFSTKGKLYEYSTDSCMDKILDRYERYSYAEKVLISVESETQGNWCHEYRKLKAKVETIQKCQKHLMGEDLETLNLKELQQLEQQLESSLKHIRTRKSQLMLESISELQRKEKSLQEENKVLQKELAEKQKAQRKQVQWGQTQQQTSSSSSCFMIREAAPTTNISIFPVAAGGRLVEGAAAQPQARVGLPPWMLSHLSS

SEQ ID NO: 9872 - protein, 389 aa, Zea mays; identical to SEQ ID NO: 5569

SEQ ID NO: 9873 - protein, 229 aa, Zea mays; identical to SEQ ID NO: 4279

SEQ ID NO: 9874 - protein, 709 aa, Zea mays
MQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 9875 - protein, 244 aa, Zea mays; identical to SEQ ID NO: 4365

SEQ ID NO: 9876 - protein, 261 aa, Zea mays; identical to SEQ ID NO: 4116

SEQ ID NO: 9877 - protein, 259 aa, Zea mays; identical to SEQ ID NO: 4714

SEQ ID NO: 9878 - protein, 136 aa, Glycine max; identical to SEQ ID NO: 3859

SEQ ID NO: 9879 - protein, 239 aa, Glycine max
MGRGRVDLKRIENKINRQVTFSKRRSGLLKKAREISVLCDADVALIVFSTKGKLFDYSNEPCMKRILERYERYSYAERQLAGDDQAPNENWVIEHEKLKARVEVLQRNQRNFMGEDLDSLNLRGLQSLEQQLDSALKLIRSRKNQAMNESISALQKKDKSLREHNNLLSKKIKDKEKELAPQEQDGLQNNMDVTSVLVTQPPESLTIGGFPEAKCNEETPTSSRPKTILPPWMPLPTNE

SEQ ID NO: 9880 - protein, 580 aa, Glycine max
MATPNPTRFSLAMERTGQWVFSPEIPTDVIVAVGQTNFSLHKFILAAKSNYVRKVIMESEESDLTRIEISDIPGGSEAFEKAAKFCYGVNFEITVHNVAALHCAAVFLQMTDEYCDGNLAGRTEDFLSQVGLSTLHSAVAVLKSCQKILPFAAEVNVVDRCVEVISCKACNEANFPSQSPPNWWTEELAVLDVDSFAKVIAAMKQRGAKYLTVAGALITYTERALRELVRDHSGGGRGIRSPESGDSDSESKRSEQRELLQAIVPLFPTEKAAFPINFLCCLLRCAIYLRASSACKRELEKRVTEILEHVTVDDLLVLTFSYDGERLLDLDSVRRIISGFVEREKGTTVFNAGVNFNEDFSAAMQRVAKTVDSYLAEIAAYAELSISKFNGIAILIPKGARKSDDDLYRAVDIYLKVHPNLDEIEKEKVCSVLDTLKLSYEARVHASKNKRLPLQIVLHALYYDQLQIRSGTAADKQAVVAAAEKKQLQADVSLVRENEELRSELMKMKMFISDLQKNVHGTSSSGRENIGPTKKPTFFSSMSKKLSKLNPFKNGSKDTSHIDDAPVDLTKPRKRRFSIS

SEQ ID NO: 9881 - protein, 149 aa, Glycine max; identical to SEQ ID NO: 3905

SEQ ID NO: 9882 - protein, 368 aa, Zea mays
MDRELLETFDAAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARPVKIEKNSASASMKLEKRDVDVTGQKPNNAKVEKTTSNGSKAQSVKVERISKEVIRTPDAKRPASVPNGHPKLTSLVKCNDPTRDKIRELLAEAFVRVSRETSDDDRDEVRNILDEVEACDPYRVAVTVESALFERLGPSTGTHRAKYRSIMFNLRAENNTDFRRRVLIGLVAPERLPGIPPDEMASDARKQENMQIKEKALFDCERGAAPKATTDQFKCARCGQRKTTYYQLQTRSADEPMTTFVTCVNCNNHWKFC

SEQ ID NO: 9883 - protein, 252 aa, Zea mays
TNRVMDSSLIDSENSMPGCACSHPECSPENCGHVSLFDGVYNSLVDINGTPMHGRFAYDEDSKIILQEGYPIYECNSSCICDSSCQNKVLQKGLLVKLELFRSENKGWAIRAAEPILQGTFVCEYIGEVVKADKAMKNAESVSSKGGCSYLFSIASQIDRERVRTVGAIEYFIDATRSGNVSRYISHSCSPNLSTRLVLVESKDCQLAHIGLFANQDIAVGEELAYDYRQKLVAGDGCPCHCGTTNCRGRVY

SEQ ID NO: 9884 - protein, 337 aa, Zea mays
QQKKKPKRGGAGGRRSFAAEDDEDFEADFEDFEADSGDSDLELGEGADDDVIEIKPFAAKSTFSRDGLSTMTTAGYDAPAARLAKRKRKNQYRGIRQRPWGKWAAEIRDPQKGVRVWLGTFNSPEEAARAYDAEARRIRGKKAKVNFPDAPAVGQKCRSSSASAKALKSCVEQKPIVKTDMNILANTNAPFYQSVNYASNNPFVPAMNSTVSFEDPIMNLHSDQGSNSLGCSDLGWENDTKTPDITSIAPIPTIAEGDESVFVNSNSNSSMVPPVLENNAVDLTDGLTDLESYMRFLMDGGASDSIDSLLNLDGSQDLGSNMDLWTFDDMPIAGDFF

SEQ ID NO: 9885 - protein, 355 aa, Zea mays
MATTATNRRVILKEYVEGYPREEHMELLQGAEVPLRLTGAEPAGSVLVRNLYLSCDPYMRPKMSRPLRESYTAAFVPGDTITGYGVARVVDSSDPRLAPGDLVWGITGWEDYSVVTPPATRLLSKISHHGVGEGAGVPLSYYTGILGMPGLTAYVGFHEICAPKKGETVFVSAASGAVGQLVGQFARLAGCHVVGSAGSREKVELLKTRFGFHDAFNYKEEPDLGAALKRCFPDGIDIYFENVGGAMLDAVLLNMRVHGRIAVCGLISQYNLADGEKDAVRNLAAVISKRLRLQGFIEPDHKHLYPQYEAWVLPYIRDGTLAYVEDVAEGLESAPKALIGLFHGRNVGKQLVRVA

SEQ ID NO: 9886 - protein, 346 aa, Zea mays
  misc_feature (346)..(346): Xaa can be any naturally occurring amino acid
  unsure (1)..(346): unsure at all Xaa locations
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLVPTKIHDRSPIFLGSYDDVEEIKALYAEQAKSSSASSX

SEQ ID NO: 9887 - protein, 133 aa, Zea mays
  misc_feature (133)..(133): Xaa can be any naturally occurring amino acid
  unsure (1)..(133): unsure at all Xaa locations
QIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLAX

SEQ ID NO: 9888 - protein, 289 aa, Zea mays
  misc_feature (289)..(289): Xaa can be any naturally occurring amino acid
  unsure (1)..(289): unsure at all Xaa locations
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNAX

SEQ ID NO: 9889 - protein, 303 aa, Zea mays
  misc_feature (303)..(303): Xaa can be any naturally occurring amino acid
  unsure (1)..(303): unsure at all Xaa locations
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDEX

SEQ ID NO: 9890 - protein, 170 aa, Zea mays
  misc_feature (170)..(170): Xaa can be any naturally occurring amino acid
  unsure (1)..(170): unsure at all Xaa locations
GSPGFGFVGERIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRNX

SEQ ID NO: 9891 - protein, 335 aa, Zea mays
HEEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFG

SEQ ID NO: 9892 - protein, 1089 aa, Zea mays
  misc_feature (1089)..(1089): Xaa can be any naturally occurring amino acid
  unsure (1)..(1089): unsure at all Xaa locations
LPETSRIRLQSNRQSRQGRSRGRRARRGEMAGNDWINSYLEAILDAGGAAGDLSAAAGSGDGRDGTAVEKRDKSSLMLRERGRFSPARYFVEEVISGFDETDLYKTWVRTSAMRSPQERNTRLENMSWRIWNLARKKKQIEGEEASRLSKQRMEFEKARQYAADLSEDLSEGEKGETNNEPSIHDESMRTRMPRIGSTDAIDTWANQHKDKKLYIVLISIHGLIRGENMELGRDSDTGGQVKYVVELARALGSTPGVYRVDLLTRQISAPDVDWSYGEPTEMLSPISSENFGLELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLDQILKQGRQTRDEINATYKIMRRIEAEELCLDTSEIIITSTRQEIEQQWGLYDGFDLTMARKLRARIRRGVSCFGRYMPRMIAIPPGMEFSHIAPHDVDLDSEEGNGDGSGSPDPPIWADIMRFFSNPRKPMILALARPDPKKNITTLVKAFGEHRELRNLANLTLIMGNRDVIDEMSSTNAAVLTSALKLIDKYDLYGQVAYPKHHKQSEVPDIYRLAARTKGVFINCALVEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKDX

SEQ ID NO: 9893 - protein, 447 aa, Zea mays
  misc_feature (447)..(447): Xaa can be any naturally occurring amino acid
  unsure (1)..(447): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPYX

SEQ ID NO: 9894 - protein, 362 aa, Zea mays
  misc_feature (34)..(34): Xaa can be any naturally occurring amino acid
  misc_feature (66)..(66): Xaa can be any naturally occurring amino acid
  misc_feature (74)..(74): Xaa can be any naturally occurring amino acid
  misc_feature (102)..(102): Xaa can be any naturally occurring amino acid
  misc_feature (113)..(113): Xaa can be any naturally occurring amino acid
  misc_feature (147)..(147): Xaa can be any naturally occurring amino acid
  misc_feature (174)..(174): Xaa can be any naturally occurring amino acid
  misc_feature (185)..(185): Xaa can be any naturally occurring amino acid
  misc_feature (195)..(195): Xaa can be any naturally occurring amino acid
  misc_feature (209)..(210): Xaa can be any naturally occurring amino acid
  misc_feature (214)..(214): Xaa can be any naturally occurring amino acid
  misc_feature (228)..(228): Xaa can be any naturally occurring amino acid
  misc_feature (237)..(237): Xaa can be any naturally occurring amino acid
  misc_feature (244)..(244): Xaa can be any naturally occurring amino acid
  misc_feature (294)..(295): Xaa can be any naturally occurring amino acid
  misc_feature (299)..(299): Xaa can be any naturally occurring amino acid
  misc_feature (302)..(302): Xaa can be any naturally occurring amino acid
  misc_feature (321)..(321): Xaa can be any naturally occurring amino acid
  unsure (1)..(362): unsure at all Xaa locations
ASERCLISHTPQRKILHLRVQVLPRELEPGVTCXTLLCSKPQSMVWLLGIVYQRRCSRSSTNGQSXNFHILEPXQLCSISLVLLEFSYADSSSSLSMTALIXGQCGSSYLLLXCSISPSSQTVNSCFMPTWILSLCSALLCLYLSRXERRCISISHGHHSRHGFHSPQYLVEVXSMFSQTTNSLXLLTPGQWPTXQACPLISCTSSMLXXPLGXTHGALCYTTTLRPXCYSHSSFSXWENLIRXRSTAPKCQTGFHLMWSSLLLSHACLDYQYPSSDSPADELFLLLGSQCLAXXTSSXLLXLICLSGTSMPLLWVPLGSXYACQVVCSTSNPPRNRRHPRLSRRKRATRSSRNCCRCREFK

SEQ ID NO: 9895 - protein, 345 aa, Zea mays
  misc_feature (345)..(345): Xaa can be any naturally occurring amino acid
  unsure (1)..(345): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVTVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAVEAEKKAAAPIPRNKGGMLDGEDVPLKARVSGVPAVDLEDGDVKGX

SEQ ID NO: 9896 - protein, 148 aa, Zea mays
  misc_feature (148)..(148): Xaa can be any naturally occurring amino acid
  unsure (1)..(148): unsure at all Xaa locations
TSRLVLGVTTTLVIVNCLTTFQIYAMPVYDNMEAGYVHKKNRPCPWWMRSGFRAFFGAVNFLIAVALPFLSQLAGLLGGISLPVTLAYPCFMWVAIKKPRKGTATWNVNWALGILGMSISLVLIVGNLWGLVEKGLRVKFFKPADSQX

SEQ ID NO: 9897 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 9898 - protein, 404 aa, Zea mays
  misc_feature (404)..(404): Xaa can be any naturally occurring amino acid
  unsure (1)..(404): unsure at all Xaa locations
GNKTMDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGCFPGGGMPGGFPGGGMPGGFPGGVPGNVDMSKILNDPDLMAAFSDPEVMAALQDVMNNPANFAKHQANPKVGPIIAKMMAKFNGSQX

SEQ ID NO: 9899 - protein, 229 aa, Zea mays
  misc_feature (110)..(110): Xaa can be any naturally occurring amino acid
  misc_feature (153)..(153): Xaa can be any naturally occurring amino acid
  misc_feature (164)..(164): Xaa can be any naturally occurring amino acid
  misc_feature (190)..(190): Xaa can be any naturally occurring amino acid
  misc_feature (208)..(208): Xaa can be any naturally occurring amino acid
  unsure (1)..(229): unsure at all Xaa locations
TRPKRTTETAWADPSSDGPSEHQTTTFLPPFVFASAYLPAAGKGALDLPAVPVRQSTGWQWPHQHRTLHLLHFTDCTKILSKIPHLHQNLHHQLTNHSKPWVLITQEMLXFQAWRVIMSVSFIQRVPILTSRRSLGPSTESFNCIFWSWQIYXLRDHLNMLVGXKILRSYSRTYIIFSIPYDLIRQGPHXFTCLRAKFGTARKQLKIXSRGGRKRKRCLGNHCLSWMEV

SEQ ID NO: 9900 - protein, 158 aa, Zea mays
  misc_feature (158)..(158): Xaa can be any naturally occurring amino acid
  unsure (1)..(158): unsure at all Xaa locations
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKAX

SEQ ID NO: 9901 - protein, 303 aa, Zea mays
  misc_feature (303)..(303): Xaa can be any naturally occurring amino acid
  unsure (1)..(303): unsure at all Xaa locations
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYVAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDEX

SEQ ID NO: 9902 - protein, 763 aa, Zea mays
  misc_feature (763)..(763): Xaa can be any naturally occurring amino acid
  unsure (1)..(763): unsure at all Xaa locations
MAILSALATEVFIPVAAVIGIAFAVVQWVLVSRVKLSPAAAASGGSKNGYGDYLIEEEEGLNDHNVVVKCAEIQTAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTVLMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKYLX

SEQ ID NO: 9903 - protein, 279 aa, Zea mays
  misc_feature (279)..(279): Xaa can be any naturally occurring amino acid
  unsure (1)..(279): unsure at all Xaa locations
DHTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 9904 - protein, 459 aa, Zea mays
  misc_feature (459)..(459): Xaa can be any naturally occurring amino acid
  unsure (1)..(459): unsure at all Xaa locations
AAETLPMELDPSEALVAAAVEAKGEEAANGRREFVMGRNVHTSCFAVKEPDADDEETGEREATMASVLALYRRSLVERTKHHLGYPYNLDFDYGALTQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFQRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGIGAMLNELSSTVVFERPKDEEFVRRWQLACEGNIAHVVVMPSVNIDKLDYFLNELVEKRATWYQDGISQPPCIARDVGVENCLCGLHKX

SEQ ID NO: 9905 - protein, 481 aa, Zea mays
  misc_feature (481)..(481): Xaa can be any naturally occurring amino acid
  unsure (1)..(481): unsure at all Xaa locations
MSFRSIVRDVRDGFGSLSRRSFEVTLASIYGLTGHHKGKTQSSSHVLDDSPSIIRESRWANLPPELIRDIIRRLEADESTWPARKHVVCFAAVCRTWREMCKEIVLSPEFCGKLTFPVSLKQPGPRDGNTMVQCFIKRNKSKSTYHLYLCLSNVVTSESGKFLLSAKRHRKTTCTEYTISMDSGNISRSKRTYIGKIRSNFLGTRFLIYDTQPPYNGAVVPPAGRTSRRFNSTKVSPKLPSVSYNIAQVSYELNVLGTRGPRRMRCIMHSIPASSVEPGGTVPGQPEQIVPRALEDSFRSTASFSQSFRSTASFSKSIMDSSMDFNSARFSDIAGSSARFTGVPGSSARFAGVPGSSARFSGIAGARLDNDEESETKERPLVLRNKPPRWHEQLQCWCLNFRGRVTIASVKNFQLIAAATPPPAGAPTPSQPAPSDPDKVILQFGKVARDMFTMDYRYPLSAFQAFAICLSSFDTKLACEX

SEQ ID NO: 9906 - protein, 313 aa, Zea mays
  misc_feature (313)..(313): Xaa can be any naturally occurring amino acid
  unsure (1)..(313): unsure at all Xaa locations
MAESFVLNTGSRIPSVGLGVWQIQPDAANDAIYAAVKAGYRHIDCAAAYNNEKEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEIX

SEQ ID NO: 9907 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 9908 - protein, 227 aa, Zea mays
MDEENVVELLQRYRRDRQVLLNYILSGNLIKKVAMPPGAISLDDVDIDQVSVDYVLNCAKKGEPLDLGDAIRLFHDSLDYPYVNNTGAVDEFYLLTKPEYSGPAPTREPPPIPATAPSSVVVPPPDVEPAPIIVSSPVTATNLPKSQPFDSPTEKELTIDDIEDFEDDEDEFDGRRASRRHQTDASDLSLLLPLFETGITDNDLRETAYEILVAAAGASGGLIVPQK

SEQ ID NO: 9909 - protein, 294 aa, Zea mays
  misc_feature (294)..(294): Xaa can be any naturally occurring amino acid
  unsure (1)..(294): unsure at all Xaa locations
TPHPSRSQRTLHPVRRPPAMAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKAX

SEQ ID NO: 9910 - protein, 540 aa, Zea mays
  misc_feature (540)..(540): Xaa can be any naturally occurring amino acid
  unsure (1)..(540): unsure at all Xaa locations
WMNDPNGPVYYKGWYHLFYQYNPDGAIWGNKIAWGHAVSRDLIHWRHLPLAMVPDQWYDTNGVWTGSATTLPDGRLAMLYTGSTNASVQVQCLAVPADDADPLLTNWTKYEGNPVLYPPPGIGPKDFRDPTTAWIDPSDGAWRVVIGSKDDDGHAGIAVVYRTTDLVHFELLPGLLHRVDGTGMWECIDFYPVATRGRASANGVDMSDAIASNGAVAGDVLHVMKASMDDDRHDYYALGRYDAAANAWTPIDAGRDVGIGLRYDWGKFYASKTFYDPAKRRRVLWGWVGETDSERADVSKGWASLQGIPRTVLLDTKTGSNLLQWPVEEVETLRTNSTDLSGITIDYGSVFPLNLRRATQLDIEAEFQLDRRAVMSLNEADVGYNCSTSGGAAGRGALGPFGLLVLADRRLRREQTAVYFYVAKGLDGSLATHFCQDESRSSSATDIVKRVVGSAVPVLEDEATLSLRVLVDHSIVESFAQGGRSTATSRVYPTEAIYANAGVFLFNNATAARVTATKLVVHEMDSSYNHDYMAPVADIX

SEQ ID NO: 9911 - protein, 500 aa, Zea mays
  misc_feature (500)..(500): Xaa can be any naturally occurring amino acid
  unsure (1)..(500): unsure at all Xaa locations
MRRGSAYLIGFLFKNTKLYLADEASDMMSTLIILLSDTDKATVSAALEAFSRVVASVPKEQLPTHIKLVRDAVSTARDKERRRRKGVPILLPGLCLSKALQPFLPIFQQGLISGSAETKEQAAEGLGELIDVTSEKTLKEVVVPITGPLIRILGDRFPWQVKSAILSTLTIIIMKGGIALKPFLPQLQTTFVKCLQDNNKSVRTRAAAALGKLSALSTRVDPLVSDLLSMLQSGDESVKESVLSALKGVIKHAGKSVSAPIRSRGCALLEDLLQAEADDIRSCAAKVIGTLSQYMDDREIPDLVQILLEVGTSSDWCTRHGALLALSSISMHSPSKLCDLASFPSLVDLLKDSLKDDKFPVREVATRTLGRILVFELQSEADTLQLVQLLVLALRDDSSEVRRRSLSCIKAAAKMNHSALATHHSILGPAIADALKDSSMPVRLAAERCALHVFQLTKGPDNVTTAQKYLGMTGLEVKKIAKLNEESDGSESSDDDRRTX

SEQ ID NO: 9912 - protein, 389 aa, Zea mays
  misc_feature (389)..(389): Xaa can be any naturally occurring amino acid
  unsure (1)..(389): unsure at all Xaa locations
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSYX

SEQ ID NO: 9913 - protein, 548 aa, Zea mays
  misc_feature (548)..(548): Xaa can be any naturally occurring amino acid
  unsure (1)..(548): unsure at all Xaa locations
KKLSLPPSPVLLLARCLRRRDRDTMAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIIGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADAX

SEQ ID NO: 9914 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 9915 - protein, 236 aa, Zea mays
AGGSGFESLKRLGHISPAVQSHLKHVYLTLCSALAFSALGAYLHILLNVGGALTTVGCVASIAFLISLPASRDQERNRLALLMSAALLQGASVGPLVDLVIDLDSRILVTAFVGTAVAFACFSGAAIIAKRREYLYLGGLLSSGLSILLWLQFATSIFGHTSATFMFELYFGLLVFLGYMVFDTQEIIERAHRGDMDYIKHALTLFTDFVAVLVRILVIMMKNAQEKSQDEKKRKK

SEQ ID NO: 9916 - protein, 279 aa, Zea mays
ASAHANEEKRWVLSDFEVGKPLGRGKFGHVYLAREKRSNQIVALKVLFKSQLKQSQVEHQLRREVEIQSHLRHPNILRLYGYFYDQTRVYLILEYAAKGELYKELTRCKHFSERRSATYIASLARALIYLHGKHVIHRDIKPENLLVGAQGEIKIADFGWSVHTFNRRRTMCGTLDYLPPEMVEKTEHDYHVDIWSLGILCYEFLYGVPPFEAKEHSETYRRIVKVDLKFPLKPFVSPAAKDLISQMLVKNSAQRLPLHKVLEHPWIVQNADPSGVCRG

SEQ ID NO: 9917 - protein, 262 aa, Zea mays
  misc_feature (262)..(262): Xaa can be any naturally occurring amino acid
  unsure (1)..(262): unsure at all Xaa locations
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQX

SEQ ID NO: 9918 - protein, 702 aa, Zea mays
  misc_feature (702)..(702): Xaa can be any naturally occurring amino acid
  unsure (1)..(702): unsure at all Xaa locations
MRLSSSLQDLPTFTRIDALERGSSVGSDLSSGRPKPVRMLQRDGAVASFSKERTPPSSPTNRKKCMRAAGCAIALILLVFFAYGSWRYFHVFLSEGRSEYYVVLDCGSTGTRVYVYEWHINHNDANAFPIVLKPLGNAPKKKSGKLTRLYQRMETEPGLSKLVHNESGLKKAIEPLLQMAEKLIPRHAHKHTPLFLYATAGVRKLPSADSEWLLDKSWDILNNSSFLCSRDRVKIISGMDEAYYGWIALNHNMDMLGTSSSKMTYGSLDLGGSSLQVTFENDKSVQDETSIRLSIGSVEHHLSAYSLTGYGLNDAFDKSVAHLVKRLGGVASNGKVQVKHPCLQTGFKEDYICSYCHPLKQDGSPSVGEKNSGKEKQGIAVELVGAPQWNECSALAKVTVNLSEWSSASPGLDCNIHPCALASNFPRPYGQFFAISGFYVVFKFFNLTADATLGDVQKRGQEFCEKPWKVAKSSVPPQPFVEQYCFRAPYISSLLREGLQIKDSQVIIGSGSITWTHGVALLEAGQALSSRLDIQGYRILHREINPNILIVLFLISIVLVICAILCVSNSIPRSFRKSYLPIHRHNSGGSSVLGMGLPFKHLLWNPISSGDGRTKTPLSPTVAGSDPHPFAGLGGSSVELMESSRQSLGAYHSYSVGSLGQMQFSSGVRNPSRGQTTLQSRRSQSREDLSSSLADIHFPKVX

SEQ ID NO: 9919 - protein, 277 aa, Zea mays
MSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVARELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 9920 - protein, 451 aa, Zea mays
  misc_feature (451)..(451): Xaa can be any naturally occurring amino acid
  unsure (1)..(451): unsure at all Xaa locations
VSMALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCAEVVTKIKVLARDSERNRRCFASIGTGRVLAAAFESLAAAAAADAAAPAGRVLEDILAALVCMMPLDEEAARTLALPTSLGSLVAIAENGSLAGRLNAVLAIKEVVSCDGAVTDLSGKADEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSSX

SEQ ID NO: 9921 - protein, 158 aa, Zea mays
VAAAPVAAMDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKG

SEQ ID NO: 9922 - protein, 542 aa, Zea mays
  misc_feature (542)..(542): Xaa can be any naturally occurring amino acid
  unsure (1)..(542): unsure at all Xaa locations
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTPTGVMATLCFFRFWLGFGIGGDYPLSATIMSEYANKKTRGAFIAAVLAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMVTAESNTFGLFSREFARRHGLHLVGTSTTWFLLDIAFYSQNLFQKDIFTSINWIPKANTMSALEEVFRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDDAVGTRAVRPSGTQMVX

SEQ ID NO: 9923 - protein, 156 aa, Zea mays; identical to SEQ ID NO: 4245

SEQ ID NO: 9924 - protein, 372 aa, Zea mays
  misc_feature (372)..(372): Xaa can be any naturally occurring amino acid
  unsure (1)..(372): unsure at all Xaa locations
QLPRAHFAVFHSITPSPPVPRPFPLSHLLPPHLAMAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYAX

SEQ ID NO: 9925 - protein, 312 aa, Zea mays
  misc_feature (312)..(312): Xaa can be any naturally occurring amino acid
  unsure (1)..(312): unsure at all Xaa locations
DPVTAHLLLQTLTPLPVPIPLRKIGRGRREVDREEMHRDRGVSAAAIPGDRKRIGEPMDRSSPSTSWGFSGGREKERIGVGKQPEMPRSGGGSTAMSKSKLSDAESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKPX

SEQ ID NO: 9926 - protein, 362 aa, Zea mays
  misc_feature (362)..(362): Xaa can be any naturally occurring amino acid
  unsure (1)..(362): unsure at all Xaa locations
CGKMPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACEX

SEQ ID NO: 9927 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 9928 - protein, 390 aa, Zea mays
  misc_feature (390)..(390): Xaa can be any naturally occurring amino acid
  unsure (1)..(390): unsure at all Xaa locations
PSFLPSPPLRSASAATASHTLTLPRPLSAPSASPQGEEAMAAGGNGAGGDTRAAFARIYKTLKEELLTDPAFEFTEESRQWIDRMVDYNVLGGKCNRGLSVVDSYKLLKGADALGEEETFLACTLGWCIEWLQAFFLVLDDIMDDSHTRRGQPCWFRVPQVGLIAANDGIILRNHISRILRRHFKGKPYYADLLDLFNEVEFKTASGQLLDLITTHEGEKDLTKYNITVHGRIVQYKTAYYSFYLPVACALLLSGENLDNYGDVENILVEMGTYFQVQDDYLDCYGDPEFIGKIGTDIEDYKCSWLVVQALERADESQKRILFENYGKKDPACVAKVKNLYKELDLEAVFQEYENESYKKLIADIEAQPSIAVQKVLKSFLHKIYKRQKX

SEQ ID NO: 9929 - protein, 206 aa, Zea mays
  misc_feature (6)..(6): Xaa can be any naturally occurring amino acid
  misc_feature (69)..(69): Xaa can be any naturally occurring amino acid
  misc_feature (123)..(123): Xaa can be any naturally occurring amino acid
  misc_feature (127)..(127): Xaa can be any naturally occurring amino acid
  misc_feature (149)..(149): Xaa can be any naturally occurring amino acid
  misc_feature (202)..(202): Xaa can be any naturally occurring amino acid
  unsure (1)..(206): unsure at all Xaa locations
HASAGXPEHLSRLARPSDREGSLSCPPRRRGWPEPPRRHQAPSSGSACLRSSSFCTDVRLLRWREPLRXSSPMVCQVSTQKQSRRSSWILDFISSKKPRSSLMLRGHLSSMRSIPREASLTAXSSTXQVVQFLLWFWKDLTPLRNGALXLDQLMQKRPKPLIQTALEQCVGWTLRKIACMVRIHQNLQTERSHFSSEKLNPXLWNM

SEQ ID NO: 9930 - protein, 480 aa, Zea mays
  misc_feature (480)..(480): Xaa can be any naturally occurring amino acid
  unsure (1)..(480): unsure at all Xaa locations
DPSPGVRRASPAMADEKLAKLREATAGLTQISENEKSGFLSLVGRYLSGDEEHIEWAKIHTPTDEVVVPYDTLESPPEGTEATKKLLDKLAVLKLNGGLGTTMGCTGPKSVIEVRNGFTFLDLIVIQIESLNKKYGSNVPLLLMNSFNTHDDTLKIVEKYTNSSIEIHTFNQSQYPRVVADEFLPWPSKGKTDKDGWYPPGHGDIFPSLMNSGKLDLLLSQGKEYVFIANSDNLGAIVDMKILNHLIHKQNEYCMEVTPKTLADVKGGTLISYEGRVQLLEIAQVPDAHVNEFKSIEKFKIFNTNNLWVNLKAIKRLVEADALKMEIIPNPKEVDGVKVLQLETAAGAAIRFFDHAIGINVPRSRFLPVKATSDLQLVQSDLYTLVDGFVTRNSARTNPSNPSIELGPEFKKVGSFLGRFKSIPSIVELDSLKVSGDVWFGSGIVLKGKVTITAKPGVKLEIPDGAVIGNKDISGPEDLX

SEQ ID NO: 9931 - protein, 205 aa, Zea mays
  misc_feature (66)..(66): Xaa can be any naturally occurring amino acid
  misc_feature (76)..(76): Xaa can be any naturally occurring amino acid
  misc_feature (94)..(94): Xaa can be any naturally occurring amino acid
  misc_feature (97)..(97): Xaa can be any naturally occurring amino acid
  misc_feature (141)..(141): Xaa can be any naturally occurring amino acid
  unsure (1)..(205): unsure at all Xaa locations
PRVRANIKQARPSFSSPLTLDASPPLLPHPSIAPPSGLRSHSLTPAPPPIRVALCWKERWSRPSSXSSPTASSGAXSGTSSVASRRKGSTSRGXSSXTWRGPSRSSTTLTFPTSLSSPGWWSTSFPAPWWRWCGRGRTSCXLAAGSLGPPGLGRQPPVPFVGTTPWKSAGMSSMEATPWRTGRRRSLSGSLKVWHSGRATFIPGS

SEQ ID NO: 9932 - protein, 312 aa, Zea mays
  misc_feature (312)..(312): Xaa can be any naturally occurring amino acid
  unsure (1)..(312): unsure at all Xaa locations
ARLGMEGTAAARKRSRPETANGAAAAGKRSKDTESFQTGLSSKSKPCTKFFSTIGCPFGEGCHFLHFVPGGYPAVAKMLNLSSSAVSAPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAAX

SEQ ID NO: 9933 - protein, 274 aa, Zea mays
  misc_feature (274)..(274): Xaa can be any naturally occurring amino acid
  unsure (1)..(274): unsure at all Xaa locations
IDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETEPLLATKDNSDTKKANGVAHDCX

SEQ ID NO: 9934 - protein, 383 aa, Zea mays
  misc_feature (383)..(383): Xaa can be any naturally occurring amino acid
  unsure (1)..(383): unsure at all Xaa locations
MSMRIERDLHMATGNGETSYTKNSRIQEKAMFQMKSVLEEATRAVCTALLPQTMVVADLGCSSGPNTLRFVTEVTRIIAHHCKLEHNRRHDHPLQLQFFLNDLPGNDFNNLFQLIEQFNKSSTTHKGDAATEALQPPCYISGLPGSYYTRIFPSESVHLFHSLFCLQWRSQAPEQLKGTQKSCLDIYITKTMSPSMVKLFQQQFQKDFSLFLRLRYEELVSGGQMVLTFIGRKHEDVFTGESNHLYGLLAQSLKSLVDEGLVEKEKLESFYLPIYSPSVGEVEAIVKQLGLFNMNHVKVFEINWDPYDDSEGDDVHNNIESGENVAKCLRAVMEPLVASQFGERILDKLFKEYARRVAKHLENEKTKHAVLVLSIKKAIIHVX

SEQ ID NO: 9935 - protein, 313 aa, Zea mays
  misc_feature (313)..(313): Xaa can be any naturally occurring amino acid
  unsure (1)..(313): unsure at all Xaa locations
MAESFVLSTGSRIPSVGLGVWQIQPDAANDAIYAAVKAGYRHIDCAAAYNNEEEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVSVADKLQKTPAQVALRWGIQMGHSVLPKSANESRIKENIDIFGWSIPEDLMAKFSEIKQVRLLTAEFVVHPQAGYNTLEDFWDGEIX

SEQ ID NO: 9936 - protein, 217 aa, Zea mays
  misc_feature (217)..(217): Xaa can be any naturally occurring amino acid
  unsure (1)..(217): unsure at all Xaa locations
LAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKRGSKEEKIKAEVHKSLEGAFVLNQHQPAEHDESSSQX

SEQ ID NO: 9937 - protein, 216 aa, Zea mays
  misc_feature (216)..(216): Xaa can be any naturally occurring amino acid
  unsure (1)..(216): unsure at all Xaa locations
HWRRVRRGVGMRTICDVCESAPAVLFCAADEAALCRPCDEKVHMCNKLASRHVRVGLADPNKLARCDICENSPAFFYCEIDGTSLCLSCDMTVHVGGKRTHGRYLLLRQRVEFPGDKPGHMDDVPMEIKDPENQREQNTPKEQMANHHNVNDPVSDGNCDGQGNIDSKMIDLNMRPARTHGQGSNSQTQGVDLSVNNHDSPGVVPTSNSERDAIKX

SEQ ID NO: 9938 - protein, 555 aa, Zea mays
  misc_feature (555)..(555): Xaa can be any naturally occurring amino acid
  unsure (1)..(555): unsure at all Xaa locations
LTDMTEGLCLSKHLTNCVHSNLSFSRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDGX

SEQ ID NO: 9939 - protein, 170 aa, Zea mays
  misc_feature (170)..(170): Xaa can be any naturally occurring amino acid
  unsure (1)..(170): unsure at all Xaa locations
SPGFGFVGERIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGGGGGYGGGGGGYGGGNRGGGYGNSDGNWRNX

SEQ ID NO: 9940 - protein, 486 aa, Zea mays
  misc_feature (486)..(486): Xaa can be any naturally occurring amino acid
  unsure (1)..(486): unsure at all Xaa locations
NLSGEIPAEIGKVKSLQIALNLSSNHFTGPLPRELGRLDKLVVLDLSRNEISGQIPGDMRGMLSLIEVNLSNNRLAGAIPVFGPFQKSAASSFSGNAELCGDPLTVDCGSSIYGSSYGTETDHRGISYRVALAVVGSCVLIFSLVSLLVALFMWRERQEKEEEEAKKKAAEVAVAAAAPQVVASAVFVESLQQAIDFQSCVKATFKDENEVGDGTFSTTYRAVMPSGTVVSVKKLKSVDRAVVQQRTKVVRELERLAHIGHENLVRPIGYVLYDDVALLLHQHLANGTLLQLLHDNGERRKADWPRLLSIAVDVAQGLAFLHQVATVHLDVCSGNVFLDSRYNALLGEVEISRLLDPTKGTASISAVAGSFGYIPPEYAYTMRVTVPGNVYSFGVVLLEILTSKLPAVDEAFGEGVDLVKWVHAAPARGETPEQIMDPRLSAVSFAWRRQMLAVLRVAMLCTERAPAKRPRMKKVVEMLQEARDSX

SEQ ID NO: 9941 - protein, 376 aa, Zea mays
  misc_feature (376)..(376): Xaa can be any naturally occurring amino acid
  unsure (1)..(376): unsure at all Xaa locations
QGRSGVGGPAMVMMMRSCLGGGLLPVAVMLCLNVVAAVMVSLVKVAMDGGMKPLVIVTLQQLTAAVFLAPIAFFKERKSRPKLTLEIFAYIFVSAALGAALRQYMIFVALRYTTATFVTAFSNIAPVLTFLLAVATRSEALDLKSRTGLAKLLGTLVSLAGAMVLTLYKGVALTHAAAASQDHQQHSHGRLPPSAADSRGKWTLGTVAILGNCVCLSCWFLLHGRLAKKYPHVYSCNALMSLLSFLQVAVVGLCTQRSISPWIVTSKFNILTVLYAGIVGCGVSFVLVTWCIEKRGAVFVAAFIPVVQIIVSVIDFSILHEQLYLGSVLGSVLVIGGLYLLLWGKRQEALHCPPPPPKVAEEDPADKEQQQVQLNX

SEQ ID NO: 9942 - protein, 227 aa, Zea mays
  misc_feature (76)..(76): Xaa can be any naturally occurring amino acid
  misc_feature (92)..(92): Xaa can be any naturally occurring amino acid
  misc_feature (113)..(113): Xaa can be any naturally occurring amino acid
  misc_feature (145)..(145): Xaa can be any naturally occurring amino acid
  misc_feature (155)..(155): Xaa can be any naturally occurring amino acid
  unsure (1)..(227): unsure at all Xaa locations
PRDGGGDDGARQDRDQADRERHQPPGDLLQAPDGDHEEGARAHRALRRPGRHHHVLLHRQVPRVLQPRNRHQDHLXPVPAGHRDQPMDRAVXEYAAHAEPSQGHQSWSAHRDXAKDGRGSGQSGLRRAARPRAKRRRGSQGGSPXEVPCDQHADXYLQEKGEALARGVQEPAAGARHAGGPGVRVRGQHGRRRRLGRRGGAGRRPAGHVRLPRGAQPAQPARHGLRL

SEQ ID NO: 9943 - protein, 395 aa, Zea mays
  misc_feature (395)..(395): Xaa can be any naturally occurring amino acid
  unsure (1)..(395): unsure at all Xaa locations
HLSLSLSLSLSLSLVGTWRRGRNREQGGRRGCCDGSSLKFLDPGRQAEKHQLVKMSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDCX

SEQ ID NO: 9944 - protein, 457 aa, Zea mays
MAVSHNVGSKHGVAPLEVSVEAGNGGAAEWLDDDGRPRRTGTFWTASAHIVTAVIGSGVLSLAWAIAQLGWVAGPAAMLLFAFVTYYTATLLAECYRTGDPETGKRNYTYMDAVRSNLGGAKVAFCGVIQYANLVGVAIGYTIAASISMKAVRRAGCFHAHGHADPCNSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVS

SEQ ID NO: 9945 - protein, 249 aa, Zea mays; identical to SEQ ID NO: 9907

SEQ ID NO: 9946 - protein, 491 aa, Zea mays
  misc_feature (491)..(491): Xaa can be any naturally occurring amino acid
  unsure (1)..(491): unsure at all Xaa locations
AASLSSVLARSASLLSLSPPRPRGGGGKAGIPDVRTAAMGTQAPENYPAEKDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMEAKTYQFYSX

SEQ ID NO: 9947 - protein, 304 aa, Zea mays
  misc_feature (304)..(304): Xaa can be any naturally occurring amino acid
  unsure (1)..(304): unsure at all Xaa locations
RMGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDEX

SEQ ID NO: 9948 - protein, 585 aa, Zea mays
  misc_feature (585)..(585): Xaa can be any naturally occurring amino acid
  unsure (1)..(585): unsure at all Xaa locations
KFLLSKNPSGKTFAPSRRRLLPSRRRRCHPHLPRGSPPGRLLAVPRSLPRPTLALPSSMICAISGEVPDEPVVSKKSGLLFERRLIERYIEDHGKCPATKEDLTMDDIVPVKTNTIVKPRPLQAASIPGLLGIFQNEWDALMLSNFALEQQLHTARQELSHALYQHDAACRVIARLKKERDDARALLAQAERQIPASVAGAAPAAVVSNGKRVIEDEIGPDGKKIRPGINPVMIDELTECNAMLSAQRKKRQVPPTLAPIDALERYTQISSHPLHKTNKPGILSMDIHPSKDIVATGGIDTNAVIFDRSSGQILCTLAGHSKKITTLKFIPRDQLFVTGSADKTVRIWQENENGNYNCVHTLKDHTDEVEAVTVHVTQKYFVSASKDNSWCFYDISTGSCLTQVGDASGQEGYTSASFHPDGLILGTGTTDAVVKIWDVKAQSNVAKFEGHVGPVTAMSFSENGYFLATAAHDGVKLWDLRKLRNFRTFSPYDLDTPTNTVEFDFSGNYLAIGGSDIRVYQVANVKAEWNLIKTLPDLSGTGKVTSVKFGVDAKYIAIGSMDRNLRIFGLPGDDQMEESNTAAEX

SEQ ID NO: 9949 - protein, 289 aa, Zea mays
  misc_feature (289)..(289): Xaa can be any naturally occurring amino acid
  unsure (1)..(289): unsure at all Xaa locations
MAKDIEASGPEAGEFSAKDYTDPPPAPLADAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNAX

SEQ ID NO: 9950 - protein, 186 aa, Zea mays
  misc_feature (186)..(186): Xaa can be any naturally occurring amino acid
  unsure (1)..(186): unsure at all Xaa locations
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISNX

SEQ ID NO: 9951 - protein, 381 aa, Zea mays
MAVLSAAGAPPASAIGFEGYEKRLEITFSEAPVFVDPHGSGLRALSRSQIDSVLDLARCTIVSELSNKDFDSYVLSESSLFIYPLIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEE

SEQ ID NO: 9952 - protein, 662 aa, Zea mays
  misc_feature (662)..(662): Xaa can be any naturally occurring amino acid
  unsure (1)..(662): unsure at all Xaa locations
QTRRRKTRTVMVGNVPLGSDHPIRIQTMTTSDTKDVAKTVEEVMRIADKGADLVRITVQGRKEADACFEIKNTLVQKNYNIPLVADIHFAPTVALRVAECFDKIRVNPGNFADRRAQFEKLEYTDDDYQKELEHIEKVFSPLVEKCKQYGRAMRIGTNHGSLSDRIMSYYGDSPRGMVESALEFARICRKLDFHNFVFSMKASNPVIMVQAYRLLVAEMYNLGWDYPLHLGVTEAGEGEDGRMKSAIGIGTLLMDGLGDTIRVSLTEPPEEEIDPCQRLANLGTQAANLQIGVAPFEEKHRRYFDFQRRSGQLPLQKEGEEVDYRNVLHRDGSVLMSVSLDQLMAPDLLYRSLAAKLVVGMPFKDLATVDSILLRELPPVEDAEARLALKRLVDISMGVLAPLSEQLTKPLPHAIVLVNLDELSSGAHKLLPEGTRLAVTLRGDESYEQLDILKDVDDITMLLHNVPYGEEKTGRVHAARRLFEYLQANGLNFPVIHHINFPETIDRDGLVIGAGANVGALLVDGLGDGVFLEAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKTVVQRGIAMEGATDALIQLIKDHGRWVDPPAEEX

SEQ ID NO: 9953 - protein, 455 aa, Zea mays
  misc_feature (455)..(455): Xaa can be any naturally occurring amino acid
  unsure (1)..(455): unsure at all Xaa locations
FPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWAVVCYEVRYTGLSVIFCMHMHYHIRSRVAGFLLLKNNGVVGWGEAMCVARYSFVLLTLLIX

SEQ ID NO: 9954 - protein, 169 aa, Zea mays
  misc_feature (169)..(169): Xaa can be any naturally occurring amino acid
  unsure (1)..(169): unsure at all Xaa locations
AEKLKHFIIWNGVFDFREQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGSX

SEQ ID NO: 9955 - protein, 140 aa, Zea mays
  misc_feature (140)..(140): Xaa can be any naturally occurring amino acid
  unsure (1)..(140): unsure at all Xaa locations
IDEPFKALGVDYTGDVVIPSLESHNVRQLYPKGPNIDFKKELRTLNRELQLHILELADILVERPSQYARRVEDITLIFKNLHHLLNSLRPHQARATLIHMLESQIRHRKEAIEDIKQRREEAQKMLGESLLILDGSQTNX

SEQ ID NO: 9956 - protein, 375 aa, Zea mays
  misc_feature (375)..(375): Xaa can be any naturally occurring amino acid
  unsure (1)..(375): unsure at all Xaa locations
MSGGGVDGAPVAEFRQTVTHGGRFLQYNIFGNLFEITHKYQPPIMPIGRGAYGIVCSVMNSETKEMVAIKKIANAFDNHMDAKRTLREIKLLRHLDHENIIGIRDVIPPPVPQAFNDVYIGTELMDTDLHHIIRSNQELSEEHSQYFMYQILRGLKYIHSANVIHRDLKPSNLLVNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQFPRRPFVSLFPRMQPVALDLIERMLTFNPLQRITVEEALEHPYLERLHDVADEPICTDPFSFDFEQQALTEDQMKQLIFNEAIELNPNFRYX

SEQ ID NO: 9957 - protein, 304 aa, Zea mays
  misc_feature (304)..(304): Xaa can be any naturally occurring amino acid
  unsure (1)..(304): unsure at all Xaa locations
RMGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEAEEIEALYKKVHAAIRADPSVVKSTKQPPKEHKRYNPKKLTYEQRKASLIERLNQLNSSGGADDDDEDDEX

SEQ ID NO: 9958 - protein, 157 aa, Zea mays
  misc_feature (157)..(157): Xaa can be any naturally occurring amino acid
  unsure (1)..(157): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRNX

SEQ ID NO: 9959 - protein, 78 aa, Zea mays
ALKLVNVERSFAEKHYADLASKPFFQGLVDYIISGPVVAMVWEGKSVVTTGRKIIGATNPLASEPGTIRGDFAVDIGR

SEQ ID NO: 9960 - protein, 483 aa, Zea mays
  misc_feature (483)..(483): Xaa can be any naturally occurring amino acid
  unsure (1)..(483): unsure at all Xaa locations
LWTHQSVNPEWEQRHVQVQPGSSYYAGTASDPSNLGVQVAVGVPGNTANVGICDLRNHECPHVHNSYPHAGVTSRFVFPTTMYSPSMSAAAVNIYIPQTQSFGLGSVLPPSLHNQVSTGIIDESSSSVNFGDSAIGFMKRKNAVVAGSHNFLHGFAGSSSSVHVPQNPVHGAWNPSSQSNCLPSSAASNLPEYHNSNGWPYLEESSADASNSFSSVAACPELAPHGNYLYPACHISQSNTWVPQPAGYGVPQWGYSNAVVNPPDMSNGPLPHFCQNSMQAPQIQVPHQQSIGNNVVHGLNPSATGLPLHPRMLALPFNAEHTFGHPMHPPLINQANNGALRILPYQNATVMDHSRIYEAGHVIDEHSDMRLDVDNMTYEELVALQEQIGDVNTGLTESYIQENLRSSFHVPGAASMSDQFSELSLENDACIICQEEYKAKELIGTLECGHKYHVNCIKQWLMMKNLCPICKTTALSSDRRNGX

SEQ ID NO: 9961 - protein, 166 aa, Zea mays
  misc_feature (166)..(166): Xaa can be any naturally occurring amino acid
  unsure (1)..(166): unsure at all Xaa locations
MSSHRVKWNEDNLYEIESNKPVRQKITEPKTPYHPMIDDDGSLSPTRPFDKCLDETVQAEAILTALNGVASSSISISKDDGWGSSDDDTDAIDQDADPEADTTRLSFKEHRRAHYDEYRKVKELMRTGSLTAEEADEDNRAATSSEDKGVGKGGPNDNMKPSPQTX

SEQ ID NO: 9962 - protein, 253 aa, Zea mays
  misc_feature (253)..(253): Xaa can be any naturally occurring amino acid
  unsure (1)..(253): unsure at all Xaa locations
RFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEAEEIEALYKKVHAAIRADPSVVKSTKQPPKEHKRYNPKKLTYEQRKASLIERLNQLNSSGGADDDDEDDEX

SEQ ID NO: 9963 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 9964 - protein, 312 aa, Zea mays
  misc_feature (312)..(312): Xaa can be any naturally occurring amino acid
  unsure (1)..(312): unsure at all Xaa locations
WFTGQFVASWGFGVWSQSCPLKCRWQRFVIIMSFVFRGSRTDIEAGGFPGFAPERRAMRIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKPSEDELTCSVCLEQVTVGDLLRSLPCLHQFHVNCIDPWLRQQGTCPICKHQVSDGWHATGNGEEDASYMVX

SEQ ID NO: 9965 - protein, 357 aa, Zea mays
  misc_feature (357)..(357): Xaa can be any naturally occurring amino acid
  unsure (1)..(357): unsure at all Xaa locations
LLGGEGKRRRGAMEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKSX

SEQ ID NO: 9966 - protein, 378 aa, Zea mays
  misc_feature (378)..(378): Xaa can be any naturally occurring amino acid
  unsure (1)..(378): unsure at all Xaa locations
MASLPNGGGAAASGSCGARPVDKEVDFANYFCTYAYLYHQKEMLCDRVRMDAYHSAVFRNAPHFQGKVVLDVGTGSGILAIWSAQAGARKVYAVEATNMAEHARELARANGVTDIVEVIQGTVEDVDLPEKVDVIISEWMGYFLLRESMFDSVICARDRWLKPDGVMYPSHARMWLAPIRTGLGDKKREDFDIAMDDWSLFVQDTQTYYGVNMNALTKAYRAEHEKYYLKSSIWNNLHPNQVIGQPAAIKEIDCLTATVDEIREVRAQVTLPIRMEARLSALAGWFDVHFRGSAQNPGVEEVELTTAPDEHGGTHWGQQVFLLTPPLSVTKGDNVNVSFSMVRSKENHRLMDMEFTYELHELSGRKHPAVKTKMYLEX

SEQ ID NO: 9967 - protein, 238 aa, Zea mays
  misc_feature (238)..(238): Xaa can be any naturally occurring amino acid
  unsure (1)..(238): unsure at all Xaa locations
MAGQERRTIDLEEGWAFMQKGITKLKNILEGKPEPQFSSEDYMMLYTTIYNMCTQKPPHDYSQQLYDKYRESFEEYITSMVLPSLREKHDEFMLRELVQRWSNHKVMVRWLSRFFHYLDRYFISRRSLTPLKEVGLTCFRELIYQEIKGQVKDAVIALIDKEREGEQIDRGLLKNVLDIFVEIGLGQMECYENDFEDFLLKDTTEYYSVKAQSWILEVRYGDLRAYGSCHSKGCSHLX

SEQ ID NO: 9968 - protein, 624 aa, Zea mays
  misc_feature (624)..(624): Xaa can be any naturally occurring amino acid
  unsure (1)..(624): unsure at all Xaa locations
SPHPVSTPYKSKRGRGGKQIGWRQSVAGLAGTMGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSVLETLNFFLTDLRASPEYLTLLVRNCQRLKTLKISECFMPDLVSLFRTAQTLQEFAGGSFEEQGQPVASRNYENYYFPPSLHHLSLLYMGTNDMQILFPYATALKKLDLQFTFLSTEDHCQIVQRCSNLETLEVRDVIGDRGLQVVAQTCKKLHRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLEVRGCLFSEHALALAALQLKSLRYLWVQGFRSSPTGTDIMAMVRPFWNIEYIVPDQDEPCPEHKRQILAYYSLAGRRTDCPPSVTLLYPAFX

SEQ ID NO: 9969 - protein, 334 aa, Zea mays
  misc_feature (334)..(334): Xaa can be any naturally occurring amino acid
  unsure (1)..(334): unsure at all Xaa locations
MATSMGCLVLLCLVSSLLPSAVLGHPWGGLFPQFYDHSCPKAKEIVQSIVAQAVAKETRMAASLVRLHFHDCFVKGCDASVLLDNSSSIVSEKGSNPNRNSLRGFEVIDQIKAALEAACPGTVSCADIVALAARDSTALVGGPYWDVPLGRRDSLGASIQGSNNDIPAPNNTLPTIITKFKRQGLNVVDVVALSGGHTIGMSRCTSFRQRLYNQTGNGMADSTLDVSYAAKLRQGCPRSGGDNNLFPLDFITPAKFDNFYYKNLLAGKGLLSSDEILLTKSAETAALVKAYAADVNLFFQHFAQSMVNMGNISPLTGSQGEIRKNCRRLNNDHX

SEQ ID NO: 9970 - protein, 176 aa, Zea mays
  misc_feature (176)..(176): Xaa can be any naturally occurring amino acid
  unsure (1)..(176): unsure at all Xaa locations
PSLRSALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEAX

SEQ ID NO: 9971 - protein, 434 aa, Zea mays
  misc_feature (434)..(434): Xaa can be any naturally occurring amino acid
  unsure (1)..(434): unsure at all Xaa locations
KTRSNELGIFPPPAPPTFGTFPSGPLSSARSKSGPAMDGGGQPPDTEMTDAGAGGGGQPSPPQQPAGGAGMMENIHATLSHGGRFIQYNIFGNVFEVTSKYKPPILPIGKGAYGIVCSALNSETAEQVAIKKIANAFDNKIDAKRTLREIKLLRHMDHENIVAIRDIIPPPLREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPCHARQSFPEKFPHVQPLAIDLVEKMLTFDPRQRITVEGALAHPYLASLHDISDEPVCSMPFSFDFEQHALSEEQMKDLIYQEALAFNPDYQX

SEQ ID NO: 9972 - protein, 443 aa, Zea mays
  misc_feature (443)..(443): Xaa can be any naturally occurring amino acid
  unsure (1)..(443): unsure at all Xaa locations
TKKKNGSTNTLGGGEQESGVASMSNEEYLHTDTHGLQISETVVEPQVGRSEGDLLPTSSTDDLHISGGRTKQSDAGELRKGNSIDDSTPTYLDITIGHLPERKTASRITTEGSGEFITGKGMLAGTSSVTISAMEAGRSEDGADSIYDPSGAITPYHDSQTQTVMPHENTSTGILGPPALPVGVSTRFEEKNIMQEAPEIIKTGGKDTELKRRNFQRNKQVLKDTFDEWEEAYQRDAEQRKADELFMREALLEAQRAADIWEVPVGAVLVQNGEIIARGCNLVEDHRDSTAHAEIVCIREASNKLKTWRLADTTLYVTLEPCAMCAGAILQARIDTVVWGAPNKLLGADGSWVRLFPGDGQTSTLDSTNQSQAAGPVHPFHPKIAIRRGVLSAECSEIMQQFFQLRRKKKPQSPPQAHRHGHHHPVKFFSKMHHMFGTIFCLX

SEQ ID NO: 9973 - protein, 460 aa, Zea mays
  misc_feature (460)..(460): Xaa can be any naturally occurring amino acid
  unsure (1)..(460): unsure at all Xaa locations
SSFRGLVFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 9974 - protein, 257 aa, Zea mays
  misc_feature (257)..(257): Xaa can be any naturally occurring amino acid
  unsure (1)..(257): unsure at all Xaa locations
GGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETSPSATTAAQEVDQPDEHTAVSGTEELLAQQLKDNLHSSGDCTGHGTLSSEEDDGGVVSDEGCSFALPDAMFAAGFTHHGAEEVQLANWTSMFWNX

SEQ ID NO: 9975 - protein, 384 aa, Zea mays
  misc_feature (384)..(384): Xaa can be any naturally occurring amino acid
  unsure (1)..(384): unsure at all Xaa locations
IVLIMRPNVHSANALSRRHTRTLLCDRCGSQPASVRCLEDNASLCQNCDWNGHDAESGASGHKRQAINCYSGCPSSAELSRIWSFITDIPTVAAEPDYEDGLSMMTIDGSDVTNRHDTSDDKRLLEIANTTLMSDPPSADKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSYX

SEQ ID NO: 9976 - protein, 192 aa, Zea mays
  misc_feature (192)..(192): Xaa can be any naturally occurring amino acid
  unsure (1)..(192): unsure at all Xaa locations
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGSX

SEQ ID NO: 9977 - protein, 140 aa, Zea mays
MAEEKHHHHHLFHHKKDEEQEEQLAGGGYGESAEYTEATVTEVVSTGENEYDEYKEEKQHKHKQHLGEAGAIAAGAFALYEKHEAKKDPEHAHRHKIEEEVAAAAAVGSGGFAFHEHHEKKKDHKDAEEAGGEKKHHFFG

SEQ ID NO: 9978 - protein, 150 aa, Zea mays
  misc_feature (150)..(150): Xaa can be any naturally occurring amino acid
  unsure (1)..(150): unsure at all Xaa locations
RPQKRNSLWPLPDPDACCPGLRRRRALHQTRGDSKMPRATSDAKLLIQSLGKAYAATPTNLKIIDLYVGFAVATALIQVAYMGLVGSFPFNSFLSGVLSCIGTAVLAVCLRIQVNKDNKEFKDLPSERAFADFVLCNLVLHLVIMNFLGX

SEQ ID NO: 9979 - protein, 140 aa, Zea mays; identical to SEQ ID NO: 9977

SEQ ID NO: 9980 - protein, 299 aa, Zea mays
  misc_feature (299)..(299): Xaa can be any naturally occurring amino acid
  unsure (1)..(299): unsure at all Xaa locations
ALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMSX

SEQ ID NO: 9981 - protein, 484 aa, Zea mays
  misc_feature (484)..(484): Xaa can be any naturally occurring amino acid
  unsure (1)..(484): unsure at all Xaa locations
PTAGGAHSERSGGEGFGRAHGDASLTEAAPPTWPGAPPSPGPPHPHPPHGTGLPSPTSSSSPPAHGWRCSQRAERRRGIRPRAWRRLSDRSCSTHLARRAVLSSPLPLSSRYKMAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMSX

SEQ ID NO: 9982 - protein, 399 aa, Zea mays
  misc_feature (399)..(399): Xaa can be any naturally occurring amino acid
  unsure (1)..(399): unsure at all Xaa locations
RFERNGDGDASCQTITSHRPTVHNELKRHAVPIIYCHGQVRRVDSWSSRGAEEEGGECGGEASSAVAFRFLPVAAAVPPRTLLPVLGLTADPDLSIIQRGRNMFRRKHGSDFNSDDAEQREAKISELKAALGTLSARGEKYCSEACLRRYLEARNWNVAKSRKMLEESLKWRAAYKPEDIRWPDVSVEAETGKMYRASFRDREGRTVVVMKPTKQNTSSHEGQIRFLVYTLENAIFSLPEGQEKMVWLIDFTGWTVSHASPIKTCRETANILQNHFPERLAIGFLFNPPKVFEAFYKVIKIFLDPKSVEKVNFVYEKDEESMKVMYKYIDPEVLPVEFGGKSNVVYNHEEYSELMRQDDIKTASFWAVDAKTNHANPAINGTLVPEVAPQSSLAAKASX

SEQ ID NO: 9983 - protein, 459 aa, Zea mays
  misc_feature (459)..(459): Xaa can be any naturally occurring amino acid
  unsure (1)..(459): unsure at all Xaa locations
MGSAGGGGESKLESPLLGASSTGHGEAVIFSGHLGTLELAAASLGNTGIQVFAYGLMLGMGSAVETLCGQAYGAHKYDMLGIYLQRSTVLLMATGVPLAALYAFSRPVLLLLGESPEIASAAAVFVYGLVPQIFAYAANFPIQKFMQAQSIMGPSAYISAAALAAHLALSYLVVYRLGLGLLGASLTLSASWWAIVAAQFAYIVTSSRCRLTWRGFSWQAFSGLPSFFRLSLASAVMLCLETWYFQILVLIAGLLKDPELALASLSVCMTISGWVFMISVGFNAAASVRVSNELGAGNPRAAAFSVVVVTLLSFVLSVLVSAVILLCRDYISYIFTEGEDVSQAVSRLTPLLAFTLILNGIQPVLSGVAVGCGWQAFVAYVNVGCYYIVGIPLGCLLGFYFDLGAAGIWSGMIGGTLMQTLILIWVTFRTNWNKEVEEAQKRINKWDDGKAPLLSAQEX

SEQ ID NO: 9984 - protein, 442 aa, Zea mays
  misc_feature (442)..(442): Xaa can be any naturally occurring amino acid
  unsure (1)..(442): unsure at all Xaa locations
FGNFFGSPSPERVQPSSSSTCSAGCSSSPLSLYPRGPHSHISPLLRPARPPPKPLLPQEAMASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQIX

SEQ ID NO: 9985 - protein, 526 aa, Zea mays
  misc_feature (526)..(526): Xaa can be any naturally occurring amino acid
  unsure (1)..(526): unsure at all Xaa locations
GLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFTGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGEGKCWTSKVKSEEELTAAIETALGEKKDCLCFIEVIAHKDDTSKELLEWGSRVSAANSRPPNPQX

SEQ ID NO: 9986 - protein, 182 aa, Zea mays; identical to SEQ ID NO: 5802

SEQ ID NO: 9987 - protein, 456 aa, Zea mays
  misc_feature (456)..(456): Xaa can be any naturally occurring amino acid
  unsure (1)..(456): unsure at all Xaa locations
LELKKHLQHAVVVVIVFDSSWHLPSIKINVCPQICSLALATEPHQAPQSRAAVADAQQISSASLCGSASCQSPPQNSSPSPSPLALARGEVRWSSDPEAAMATAEVVVANGSGGADTKTAFKEIYSKLKQEMLEDPAFEFTDESLQWIDRMLDYNVLGGKCNRGLSVVDSYKILKGVDVLSKEETFLACTLGWCIEWLQAYFLVLDDIMDNSQTRRGQPCWFRVPQVGLIAVNDGIILRNHISRILQRHFKGKPYYVDIIDLFNEVEFKTASGQMLDLITTHEGEKDLTKYNLTVHRRIVQYKTAYYSFYLPVACALLLAGENLENFVDVKNILVEMGTYFQVQDDYLDCFGDPEFIGKIGTDIEDYKCSWLVVQALERAAENQKSILFENYGKSDPACVAKVKDLYKELKLEEVFHEYERESYNKLIADIEAQPSKAVQTVLKSFLHKIYKRDKX

SEQ ID NO: 9988 - protein, 229 aa, Zea mays
  misc_feature (229)..(229): Xaa can be any naturally occurring amino acid
  unsure (1)..(229): unsure at all Xaa locations
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVEELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWKX

SEQ ID NO: 9989 - protein, 158 aa, Zea mays
  misc_feature (158)..(158): Xaa can be any naturally occurring amino acid
  unsure (1)..(158): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGGGGGYGGGGGGYGGGNRGGGYGNSDGNWRNX

SEQ ID NO: 9990 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 9991 - protein, 341 aa, Zea mays
  misc_feature (341)..(341): Xaa can be any naturally occurring amino acid
  unsure (1)..(341): unsure at all Xaa locations
GKNNRATNKVVYISSIYSSESCELRSSLKTAAMAKLWTLLLAAVVVLSLLVSPIACTRKLNKPKPKPGSYRRPVKPKPKPVTGSYKPAPVAARRNHTATPTPSPTVYGPGGWLSGAGATYYGATNGDGSDGGACGYQTAVGKKPFDSMIAAGSTPLYRGGEGCGACYEVKCTTNAACSGQPVTIVITDQSPGGLFPGEVEHFDMSGTAMGAMARPGMADKLRAGGVLRILYRRVPCKYTGVNIAFKVDQGANPYYFDVLIEFEDDDGDLSAVDLMEAGSGVWTPMAHNWGATWRLNNGRKLKAPFGLRLTSDSRRVLVANNAIPAAWKPGKTYRSLVNYPX

SEQ ID NO: 9992 - protein, 502 aa, Zea mays
  misc_feature (502)..(502): Xaa can be any naturally occurring amino acid
  unsure (1)..(502): unsure at all Xaa locations
MDTVGVPVVAVANGIGEVERKVQKSYWEEHSKCLTVESMMLDSRAADLDKEERPEILSLLPSYKGKSVLELGAGIGRFTGDLAKEAGHVLALDFIESVIKKNQSINGHHKNITFRCADVTSNDLKIEDNSVDLIFSNWLLMYLSDEEVQKLVGKMVKWLKVGGHIFFRESCFHQSGDSKRKVNPTHYREPRFYTKVFKEGHSFDQDGGSFELSLVTCKCIGAYVKNKKNQNQICWLWEKVKSTEDRDFQRFLDNVQYKTSGILRYERVFGEGFVSTGGIETTKEFVGMLDLKPGQKVLDVGCGIGGGDFYMAANYDVHVLGIDLSVNMVSFAIERAIGRKCSVEFEVADCTTKDYPENSFDVIYSRDTILHIQDKPALFRSFFKWLKPGGKVLISDYCKNPGKPSEEFAAYIKQRGYDLHDVKAYGQMLKDAGFHNVIAEDRTEQFLNVLQREIGEVEKNKDAFLADFTQEDYDDIVNGWNAKLKRSSAGEQRWGLFIATKX

SEQ ID NO: 9993 - protein, 248 aa, Zea mays
  misc_feature (248)..(248): Xaa can be any naturally occurring amino acid
  unsure (1)..(248): unsure at all Xaa locations
HHTAPAPPPTERLQAPAQEGEKRRAFLGKSQEERRGTKMGRGKIEIKRIENSTNRQVTFSKRRNGILKKAREISVLCDAEVGVVVFSSAGKLYDYCSPKTSLSKILEKYQTNSGKILWGEKHKSLSAEIDRIKKENDTMQIELRHLKGEDLNSLQPKDLIMIEEALDNGLTNLNEKLMEHWERRVTNTKMMEDENKLLAFKLHQQDIALSGSMRELELGYHPDRDLAAQMPITFRVQPSHPNLQENNX

SEQ ID NO: 9994 - protein, 157 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRK

SEQ ID NO: 9995 - protein, 277 aa, Zea mays
  misc_feature (277)..(277): Xaa can be any naturally occurring amino acid
  unsure (1)..(277): unsure at all Xaa locations
LPPTRPHHHCCDESERERVGGEAAEMGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVKX

SEQ ID NO: 9996 - protein, 285 aa, Zea mays
  misc_feature (285)..(285): Xaa can be any naturally occurring amino acid
  unsure (1)..(285): unsure at all Xaa locations
RHLIFPSRLPPTRPHHHCCDESERERVGGEAAEMGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVKX

SEQ ID NO: 9997 - protein, 233 aa, Zea mays
  misc_feature (233)..(233): Xaa can be any naturally occurring amino acid
  unsure (1)..(233): unsure at all Xaa locations
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSGX

SEQ ID NO: 9998 - protein, 356 aa, Zea mays
  misc_feature (356)..(356): Xaa can be any naturally occurring amino acid
  unsure (1)..(356): unsure at all Xaa locations
PKHHRAPMAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIREFVAAMAKGGPAKDELDSKKTPTKVAGSAPAKEAVLAPAPAVEKKKAKGKDKEGFKTIEMTEKFYCRSKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGIX

SEQ ID NO: 9999 - protein, 355 aa, Zea mays
  misc_feature (355)..(355): Xaa can be any naturally occurring amino acid
  unsure (1)..(355): unsure at all Xaa locations
ALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIIRSAGNKVASAATQPLLLPSSTSTDNVX

SEQ ID NO: 10000 - protein, 483 aa, Zea mays
LRASSMASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLDPSEPTHTKVKQLLFSLLLSRKDDVIPTFRSNFSSLLATVEAELAKGGKAEFNKLNDVTSFDFIGEAYFGVRPSATELGKGGPSKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAGDFVPDRFLGEEGSKLLQYVYWSNGRETENPSVDNKQCPGKNFVVLVGRLLLVELFLRYDTFTAEVGKELLGTSVIFTGVTKATSG

SEQ ID NO: 10001 - protein, 118 aa, Zea mays
QLVAAAVLAAALLLLAAGAGTASAAVSCGEVTSSVAPCLGYAMGSAASPSAACCSGVRSLNSRASSAADRQATCNCLKSMTGRLGGGVSMANAANIPGKCGVSVGVPISPTVDCTKIN

SEQ ID NO: 10002 - protein, 558 aa, Zea mays
  misc_feature (558)..(558): Xaa can be any naturally occurring amino acid
  unsure (1)..(558): unsure at all Xaa locations
EEESFSTPPPFILGGQEERAVQKRNKGKGRGSQTNPSTCLSFACADLAMAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTDQSVVALHRIGISSVIKLLTVKX

SEQ ID NO: 10003 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10004 - protein, 237 aa, Zea mays
  misc_feature (237)..(237): Xaa can be any naturally occurring amino acid
  unsure (1)..(237): unsure at all Xaa locations
SSPAPAAPKSGNPLLRMDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEDEHIKQYKCPSCTGGGGVSNSGTKRARPSX

SEQ ID NO: 10005 - protein, 246 aa, Zea mays
  misc_feature (246)..(246): Xaa can be any naturally occurring amino acid
  unsure (1)..(246): unsure at all Xaa locations
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQQKEKSLQEENKVLQKELAEKQKAQRKQVQWGQTQQQTSSSSSCFVIREAAPTTNISIFPVAAGGRLVEGAAAQPQARVGLPPWMLSHLSSX

SEQ ID NO: 10006 - protein, 522 aa, Zea mays
  misc_feature (522)..(522): Xaa can be any naturally occurring amino acid
  unsure (1)..(522): unsure at all Xaa locations
CICLAAAPFSHRPTRSRAMDRADPARGRLAVLSSHLRGAGAEEAAGLERSPVSAPAPGPRAGALAVVDGRTGKRHEVKVSEDGTVRATDFKKITTGKDDKGLKIYDPGYLNTAPVRSSICYIDGDEGILRYRGYPIEELAESSSFVEVAYLLMYGNLPTQSQLAGWEFAISQHSAVPQGLLDIIQSMPHDAHPMGVLASAMSTLSVFHPDANPALQGQDLYKSKQVRDKQIVRVLGKAPTIAAAAYLRLAGRPPVLPLNTLSYSENFLYMLDSLGDRTYKPNPRLARALDILFILHAEHEMNCSTAAVRHLASSGVDVFTALSGGVGALYGPLHGGANEAVLKMLNEIGSMENIPDFIVGVKNRKRKMSGFGHRVYKNYDPRAKVIRKLADEVFSIVGRDPLIEVAIALEKAALSDEYFIKRKLYPNVDFYSGLIYRAMGFPTEFFPVLFAIPRMGGWLAHWKESLDDPDTKIIRPQQVYTGFWLRHYTPVRERVLSSQSEELGQVATSNATRRRRAGSALX

SEQ ID NO: 10007 - protein, 562 aa, Zea mays
  misc_feature (562)..(562): Xaa can be any naturally occurring amino acid
  unsure (1)..(562): unsure at all Xaa locations
PAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEHX

SEQ ID NO: 10008 - protein, 393 aa, Zea mays
  misc_feature (393)..(393): Xaa can be any naturally occurring amino acid
  unsure (1)..(393): unsure at all Xaa locations
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPGGGGGLELASTSKAVAGDKNWTLGCVYLIGHCLSWSGWLVLQAPVLKKYPARLSVTSYTCFFGVIQFLIIAAFMERDADAWKFHSGSELFTILYAGFIASGVAFAVQIWCIDRGGPVFVAVYQPVQTLVVAIMASLTMGEKFYLGGIIGAVLIIAGLYLVLWGKSEERARFARDAATLVSGSGDREGLLPAGGGGIRSASKAAASAATQPLLLPSSTSTDNVX

SEQ ID NO: 10009 - protein, 834 aa, Zea mays
  misc_feature (834)..(834): Xaa can be any naturally occurring amino acid
  unsure (1)..(834): unsure at all Xaa locations
QLTPPPANHPKPTSAAVVATVNMASQGEPSASASDPKEKKDFSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKSRSHVIVMGATNRPNSIDPALRRFGRFDREIDIGVPDEVGRLEVLRIHTKNMKLAEDVNLELISKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDEIAEIRAPHFEESMKYARRSVSDADIRKYQAFAQTLQQSRGFGSEFRFSDQPATAGAAAAADPFASAGAAADDDDLYSX

SEQ ID NO: 10010 - protein, 346 aa, Zea mays
  misc_feature (346)..(346): Xaa can be any naturally occurring amino acid
  unsure (1)..(346): unsure at all Xaa locations
MISFNNLFWSSLQPSFKFYRKCLTNCPYFALTMHSTTKPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDPAEIQRLATHKEVIYQKLQGGYYQLRPHVLDFLNTLVGFDIPIAIAAPRSRKSLEEGIKTVGLQGYFDAIVALEDFCLGKPDGEMFEVAAEQLGLEPDACVVFGNSNLTTESAHNAGMRCVAVAGRHPAYELQSANHVVRWLDQLSIVDLQRLANGEVIGRRGRESDMDMEIVIEEX

SEQ ID NO: 10011 - protein, 157 aa, Zea mays
  misc_feature (157)..(157): Xaa can be any naturally occurring amino acid
  unsure (1)..(157): unsure at all Xaa locations
MAAFNKLGGLLRHSALVSGITGGSSPAVFNAARLMSTKLFIGGLDWGVDDVKLREAFSSFGEVTEARVITDRETGRSRGFGFVNYSDSDAAKEAISAMDGKEIDGRQVRVNMANERPAGNRGGGGYGGGGYGGGGYGGGGGYGGGGYGGGSQSYDAX

SEQ ID NO: 10012 - protein, 607 aa, Zea mays
  misc_feature (607)..(607): Xaa can be any naturally occurring amino acid
  unsure (1)..(607): unsure at all Xaa locations
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFTGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGEGKCWTSKVKSEEELTAAIETALGEKKDCLCFIEVIAHKDDTSKELLEWGSRVSAANSRPPNPQX

SEQ ID NO: 10013 - protein, 299 aa, Zea mays
  misc_feature (299)..(299): Xaa can be any naturally occurring amino acid
  unsure (1)..(299): unsure at all Xaa locations
MARYDELASKSNVEYIAGGATQNSIRVAQWMLQIPGASSYIGCIGKDKFGEEMKKNAQAAGINAHYHEDENAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWETENVEEIALKISQLPKASGTHKKITVITQGCDPVVVADDGKVKTFPVILLPKEKLVDTNGAGDAFVGGFLSQLVQEKNIDECVRAACYAANVVIQRSGCTYPEKPDFNX

SEQ ID NO: 10014 - protein, 315 aa, Zea mays
  misc_feature (315)..(315): Xaa can be any naturally occurring amino acid
  unsure (1)..(315): unsure at all Xaa locations
MGAVASSAGGARGGDGTVLGDLPENCVAEVLLRLDPLEICRMARLSRTFRGAASGDGVWESKLPRNYARLLAVAAAGDGEGGQAAASAPGAELLPKKELYARLCRRNRFDGGKKEFWLDKGGGGLCMSISSRALSITGIDDRRYWNFIPSDESRFRTVAYLSQIWWFEVRGEVEFFFPEGTYSLFYRIHLGRPFKRLGRRVYSSEHVHGWDMKPVRFQMSTSDGQHVQSKCYLSDPGIWINHHVGDFVVKDSSRPVNIRFAMIQIDCTHTKGGLCVDSVVVKPQHLSQKKSALDLRVDSSNKLLLLSREEGYDPX

SEQ ID NO: 10015 - protein, 185 aa, Zea mays
  misc_feature (185)..(185): Xaa can be any naturally occurring amino acid
  unsure (1)..(185): unsure at all Xaa locations
PVDTCLVTCEVCSYLHHLPSPCNPLASSFIRMDYSNLRRQAASMKKTLFDQGYLDEQFCQVEDLQDEASPNFAEEVVTLFFKDSARLISNAEQALEKYPKDFNRWDAYMQQLKGSCSSIGASRMKSECVSFRDYCGQGNVEGCMRSFQKVKREHGALRQKLEAYFQLLRQAGPAGAATRPGCKNX

SEQ ID NO: 10016 - protein, 271 aa, Zea mays
  misc_feature (271)..(271): Xaa can be any naturally occurring amino acid
  unsure (1)..(271): unsure at all Xaa locations
MHPSAVSFDSGDGRRRGGAQMLLFGGGGSANSNGFFRGVPMAVLAMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYNALAADHQGLLADNDSLRAQVICLTEKLQGKETSLSATIAAQEVDQPNEHTTGTEKLLAQQLKDDLHSSCGCTGHGALSSEEEDGGVVSDEGCNFDLPDAMFAVGVTNHGAEEAQLANWTSWFWNX

SEQ ID NO: 10017 - protein, 442 aa, Zea mays
  misc_feature (442)..(442): Xaa can be any naturally occurring amino acid
  unsure (1)..(442): unsure at all Xaa locations
LEGLVVQPLVGLYSDRCTARWGRRRPFILIGCMLICLAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLMTNACCEACANLKGAFLVAVVFLVMCLTITLFFAKEVPYRGNQNLPTKANGEVETEPSGPLAVLKGFKNLPTGMPSVLLVTGLTWLSWFPFILYDTDWMGREIYHGDPKGSNAQISAFDEGVRVGSFGLLLNSIVLGFSSFLIEPMCRKVGPRVVWVTSNFMVCVAMAATALISFWSLKDYHGYVQDAITASTSIKAVCLVLFAFLGVPLAILYSVPFAVTAQLAATKGGGQGLCTGVLNISIVIPQVIIALGAGPWDALFGKGNIPAFGVASGFALIGGVVGVFLLPKISKRQFRAVSAGGHX

SEQ ID NO: 10018 - protein, 210 aa, Zea mays
GSSFPPLFLTKAAVLTLVLVQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVSV

SEQ ID NO: 10019 - protein, 389 aa, Zea mays
  misc_feature (389)..(389): Xaa can be any naturally occurring amino acid
  unsure (1)..(389): unsure at all Xaa locations
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSYX

SEQ ID NO: 10020 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10021 - protein, 258 aa, Zea mays
PGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 10022 - protein, 378 aa, Zea mays
RYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDVGIVTIFGGRLDEWRKAELRKNYSVVEKGYNSFPNSLPGTLHYKAMQARRRLHGVLCDIMRERRGQAQAGTTGLLGCLMRSRGDDGAPLLSDEQIADNVIGVLFAAQDTTASALTWIVKYLHDHPKLLEAVRAEQAAVREATGGGRQPLAWAHTKSMALTHRVILESLRMASIISFTFREAVADVEYKGFLIPKGWKVMPLFRNIHHSPDYFQDPHKFDPSRFQVAPRPSTFLPFGHGVHACPGNELAKLEMLVLIHHLVTGYRCV

SEQ ID NO: 10023 - protein, 348 aa, Zea mays
  misc_feature (348)..(348): Xaa can be any naturally occurring amino acid
  unsure (1)..(348): unsure at all Xaa locations
FPSFPFACCCLLLAVAASIPSSLSVASSTRTSSSSPFPPPPRPHRRRLASGASCDQIGEPSTQEEGAGEQEEAAGSRAWTCGGFLPAADKWCRLPALAMDPSGGAFLPPLQQGSSSFPRSSSNASLARSGSGGGGVGAGRGTRGRKMMRRVCRGVITFIFAIAGLFLGAVTGGLIGLATESGLFRGTGIGAITGALVSIEVVDSSIRLWQARRSGIWSILYVLNVIYSLLTGRLVREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKLX

SEQ ID NO: 10024 - protein, 408 aa, Zea mays
  misc_feature (408)..(408): Xaa can be any naturally occurring amino acid
  unsure (1)..(408): unsure at all Xaa locations
ARLPVVHLLHGPACRRRHCKVRTHRHTTHVTAMSAATACMPLVLDPSPLHGSAAMADAVERRQPGGMETTKTGSEGTLGRVVRSQVFGNEDDDRAGHGDGDEVSKPRAVVHTLTCERKPLFEGFALWRSIGRPELPELDPILSFDEFEFSAPAGFLDHPHRGFENVTYMLEGGISYHDFSGHKGTINPGDVQWLTAGRGVVHAEMPAAGQGVQRGINIWINLSAADKMVEPRYQDLASHDIPAAAADAAGGVSVKVIAGECLGARSPLRPRTPALCLDVALRPGARLRQPVPRGWSACAYVIHGEAAFGTASGEGNGASTATARTLVVFGGDGDGVELRGDAAGQGARVMLVAARSHGEAVARDGPFVMNTREEVDQAREDYRHRRNGFEMADGWTSDHASAAEKHSX

SEQ ID NO: 10025 - protein, 279 aa, Zea mays
  misc_feature (279)..(279): Xaa can be any naturally occurring amino acid
  unsure (1)..(279): unsure at all Xaa locations
MGRQPCCDKVGVKKGPWTAEEDQKLVGFLLTHGHCCWRVVPKLAGLLRCGKSCRLRWTNYLRPDLKRGLLSDDEERLVIDLHAQLGNRWSKIAAQLPGRTDNEIKNHWNTHIRKKLVRMGIDPVTHLPLQEPPAPAPAPAEQQEQSHRQQEELQLQELQNGRELIMQEGAGEDDITPMIQPHEIMPTAAAASNCGSVSSAHAGSASVVSPSCSSSAVSGVEWPEPMYLLGMDGIMDADWGSLFPDTGAGGGGGGFDLGVDPFDQYPGGGFDQEDDHRIX

SEQ ID NO: 10026 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10027 - protein, 136 aa, Zea mays
  misc_feature (136)..(136): Xaa can be any naturally occurring amino acid
  unsure (1)..(136): unsure at all Xaa locations
DACCPGLRRRRALHQTRGDSKMPRATSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLGX

SEQ ID NO: 10028 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10029 - protein, 380 aa, Zea mays
  misc_feature (380)..(380): Xaa can be any naturally occurring amino acid
  unsure (1)..(380): unsure at all Xaa locations
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMENX

SEQ ID NO: 10030 - protein, 291 aa, Zea mays
  misc_feature (291)..(291): Xaa can be any naturally occurring amino acid
  unsure (1)..(291): unsure at all Xaa locations
MEDERNTQQHQGGEAQQDAADQVDVKDRGLLDSLLGRKKHDDDQEKKKQTDELATGMEKVTVSEPEKHGHKEEEHEVVGEKKEGLLAKLHRTSSSSSSSSDEEEEAIDENGEIIKRKKKKMGLKEKLKEKLPGHKDGHHTAAPSPAPAPVETHAHHQEEAHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGLLGKIMDKIPGYHKSSAEEADHKADAAGEHRTSSX

SEQ ID NO: 10031 - protein, 149 aa, Zea mays; identical to SEQ ID NO: 5266

SEQ ID NO: 10032 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10033 - protein, 364 aa, Zea mays
  misc_feature (364)..(364): Xaa can be any naturally occurring amino acid
  unsure (1)..(364): unsure at all Xaa locations
MINHHEIVQFGKLYNRDMESAPAHTPLIHGLPDEVALICLARVPRRYHNILRRVSRRWRALLCSEEWHLCRKRNNLDEPWIYVICREAGIKCYVLAPDPPSRCFRIMHVIEPPCSGRKGVTIEALDKKLFLLGGCSSVYDATDEVYCYDASSNRWSSAAPMPTARCYFVSASLKEKLYITDGYGLTDKSPNSWDIYDPATDSWCTHKNPLLTPDIVKFVALGEELVTIHRAAWHRMYFAGVYDPLERTWRGRGNEIALCYSSPTVVVDGTLYMLEQSMGTKLMVWREDAKEWAMLGRLSDKVTRPPCALVAIGRKIHVVGRGLSMVTVDVDTAARVDGFLVTTSVGPLVEEDLTPERCVVITIX

SEQ ID NO: 10034 - protein, 141 aa, Zea mays; identical to SEQ ID NO: 4666

SEQ ID NO: 10035 - protein, 479 aa, Zea mays
  misc_feature (479)..(479): Xaa can be any naturally occurring amino acid
  unsure (1)..(479): unsure at all Xaa locations
MSSPAVRRVVLLSSLLCAGALGFLPCSHAAAVAPGYVAVSAASFVPSSTCSSPDRVPPHRRNGTSAVLRLTHRHGPCAPSRASSLAAPSVADTLRADQRRAEYILRRVSGRAPQLWDSKAAAAVATVPASWGYDIGTLNYVVTASLGTPGVAQTMEVDTGSDLSWVQCKPCAAAPSCYSQKDPLFDPAQSSSYAAVPCGGPVCAGLGIYAASACSAAQCGYVVSYGDGSNTTGVYSSDTLTLSASSAVQGFFFGCGHAQSGLFNGVDGLLGLGREQPSLVEQTAGTYGGVFSYCLPTKPSTAGYLTLGVGGPSGAAPGFSTTQLLPSPNAPTYYVVMLTGISVGGQQLSVPASAFAGGTVVDTGTVVTRLPPTAYAALRSAFRSGMASYGYPTAPSNGILDTCYNFAGYGTVTLPNVALTFGSGATVTLGADGILSFGCLAFAPSGSDGGMAILGNVQQRSFEVRIDGTSVGFKPSSCX

SEQ ID NO: 10036 - protein, 166 aa, Zea mays
  misc_feature (166)..(166): Xaa can be any naturally occurring amino acid
  unsure (1)..(166): unsure at all Xaa locations
KTRPPNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGLADWQSSQHPWIYEKX

SEQ ID NO: 10037 - protein, 334 aa, Zea mays
  misc_feature (334)..(334): Xaa can be any naturally occurring amino acid
  unsure (1)..(334): unsure at all Xaa locations
MATSMGCLVLLCLVSSLLPSAVLGHPWGGLFPQFYDHSCPKAKEIVQSIVAQAVAKETRMAASLVRLHFHDCFVKGCDASVLLDNSSSIVSEKGSNPNRNSLRGFEVIDQIKAALEAACPGTVSCADIVALAARDSTALVGGPYWDVPLGRRDSLGASIQGSNNDIPAPNNTLPTIITKFKRQGLNVVDVVALSGGHTIGMSRCTSFRQRLYNQTGNGMADSTLDVSYAAKLRQGCPRSGGDNNLFPLDFITPAKFDNFYYKNLLAGKGLLSSDEILLTKSAETAALVKAYAADVNLFFQHFAQSMVNMGNISPLTGSQGEIRKNCRRLNNAHX

SEQ ID NO: 10038 - protein, 257 aa, Zea mays
  misc_feature (257)..(257): Xaa can be any naturally occurring amino acid
  unsure (1)..(257): unsure at all Xaa locations
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQX

SEQ ID NO: 10039 - protein, 363 aa, Zea mays
  misc_feature (363)..(363): Xaa can be any naturally occurring amino acid
  unsure (1)..(363): unsure at all Xaa locations
STKEERTDRLLHRSDMAFAPKTSSSSSLSSALQAAQSPPLLLRRMSSTATPRRRYDAAVVVTTTTTARAAAAAVTVPAAPPQAPAPAPVPPKQAAAPAERRSRPVSDTMAALMAKGKTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALPX

SEQ ID NO: 10040 - protein, 381 aa, Zea mays
  misc_feature (381)..(381): Xaa can be any naturally occurring amino acid
  unsure (1)..(381): unsure at all Xaa locations
MASVAELKEKHAAATASVNSLRERLRQRRETLLDTDVARYSKSQGRVPVSFNPTDLVCCRTLQGHSGKVYSLDWTPEKNWIVSASQDGRLIVWNALTSQKTHAIKLHCPWVMACAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEDDVNSVKFFPDGHRFGTGSDDGTCRLFDMRTGHQLQVYSREPDRNSNELPTVTSIAFSISGRLLFAGYSNGDCYVWDTLLAEVVLNLGNLQNSHDGRISCLGMSSDGSALCTGSWDKNLKIWAFSGHRKIVX

SEQ ID NO: 10041 - protein, 153 aa, Zea mays
  misc_feature (153)..(153): Xaa can be any naturally occurring amino acid
  unsure (1)..(153): unsure at all Xaa locations
MEYSNLQQQAASLKKNLFDQGYLDEQFCQIEDLQDEASPNFTEEVVSLFFKNSTRLMTNIEQAMDRNPRDFSKWDVNMQQLKGTCSSIGACRMKNECTSFRNRCGDENVEGCMRSFQNLKREHGVLRQKLESYFQLLRQAGPAVTATRPRGMX

SEQ ID NO: 10042 - protein, 357 aa, Zea mays
  misc_feature (357)..(357): Xaa can be any naturally occurring amino acid
  unsure (1)..(357): unsure at all Xaa locations
MLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLKKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRACSLSSLALILKAESPEGFVLTHIQKTWLNGYSSGVEQAFKLX

SEQ ID NO: 10043 - protein, 496 aa, Zea mays
  misc_feature (496)..(496): Xaa can be any naturally occurring amino acid
  unsure (1)..(496): unsure at all Xaa locations
ETARGRGRRSTRNSLVASSERCEWHECVREQDRSFSFVAVVGNAASASVMGAGAQEDEEEITTVAEGGVGEEEQAAAEGAGEEEQLEQGAGGEGEGGEEKAPAVMLCSICLDTVVAGGEERSTARLQCGHEFHLDCIGSAFNAKGIMQCPNCRTIEMGNWLYANGSRSSQDVNNDEWGYDDLYDHGHSELATFVPLRIQWCPIGRLELPSLFEEGESPAPATFNDFTGQFNSEPMVPVPATPHPGPYLAYFQPAPTPVSSSSLVAERTMDGAAYHDHWNTLAGLSDGRRPWAYYPQPNSDNGIAEQQGLPLGAMAVGGVDSESQQRGSLSLFYGNGSGRPRIPGVPPMAPQFTRAHGNINDQFQQTASLFAGSQQSGGMRPLGAVGPSVPPPPENTSFCLFPPASSVPSTMEAEDVNRANQFYAWERDRLAPYPLMPVNSEGTWWSSSQQQPPPEPAASASRRLSGQWIGRLPLPPPENRSPDGSSFRPLHIPRMX

SEQ ID NO: 10044 - protein, 372 aa, Zea mays
  misc_feature (372)..(372): Xaa can be any naturally occurring amino acid
  unsure (1)..(372): unsure at all Xaa locations
MDEGQGVRYWCHMCQEVIDPMPEMKCPGCEGGFVEEMDSEDFEPAANARSDRSVSLLAPLLLGMMGGSSRRSRLRREAMVEADADQDDEEDDSDHELELSRRRRRRRRSSALFSVLEAMRDRDEVRGSDDTDSDTERDLERGRRERMERQRERLRQIERVSARGRERTESLILINSNNEAIILQGTFGSDDNQEDSSNTSSGVSLGDYFLGPALDTLLQRLAESDLSRSGTPPAKKEAVAALPTVNIEEALGCSVCLEDFEMGGEAKQMPCQHKFHSHCILPWLELHSSCPICRFQLPTEETKNNPCESASTAGTVNGGGDNAAASGSDTESTNHNEDDHSDSPIFSALSTLFSDPFSSDDDESVPHSYENX

SEQ ID NO: 10045 - protein, 531 aa, Zea mays
  misc_feature (531)..(531): Xaa can be any naturally occurring amino acid
  unsure (1)..(531): unsure at all Xaa locations
GQTAVSRGHLLPNAVRTCCPVVRPPSLLLPSNCFLNLPTQPRPCPPRRQPHSSSWGADVLWVVLLSMARKHQHVAIFTTACLPWMTGTAVNPLFRAAYLAKAGDWEVTLVVPWLSKGDQELVYPNKMRFSLPAEQENYVRRWLEERTGLLPKFDIKFYPGKFSTEKRSILPVGDISQTISDDKADIAVLEEPEHLTWYHHGRRWKSKFQKVIGVVHTNYLEYVKREKNGYISAFILKHINSWVTDIYCHKVIRLSAATQDVPRSVICNVHGVNPKFIEIGKLKHQQLCQREQAFFKGAYYIGKMVWSKGYTELLQLLHKHQMELSGLKMELYGSGEDADEVKASAERLSLDIRVYPGRDHGDSIFHDYKVFINPSTTDVVCTTTAEALAMGKIVICANHPSNVFFKRFPNCHMYNTDEEFVRLTMKALAEEPIPLSDDLRHELSWEAATERFIRVADIAPTVPVGQPPPSSQHFMRISPDELQKNMEEASAFFHNTISGFEAVRCVFGAIPNTLQPDEQQCKELGWNLQGX

SEQ ID NO: 10046 - protein, 563 aa, Zea mays
  misc_feature (563)..(563): Xaa can be any naturally occurring amino acid
  unsure (1)..(563): unsure at all Xaa locations
MADVHEPLVRRKRKKVLVDYLVKFRWILVIFVVLPISTLIYFNIFLGDMWSAMKSEKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYTPVKGGLKEIAQAYADSFAPRDGDPAKVPDFVEGMVYTESEGVMMTGVYASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAPGAVLRGEEFNGAEAVHRLEQWLIENHSYQPQYAVSELNEKDFWRMFDASHYEHCRQKYGAVGTFMSVYYKSKKGRKTEKEVQEAEAAILEPAYADEEAX

SEQ ID NO: 10047 - protein, 750 aa, Zea mays
  misc_feature (750)..(750): Xaa can be any naturally occurring amino acid
  unsure (1)..(750): unsure at all Xaa locations
TLKEIMPVLMDTLIASLASSSSERRQVAGRSLGELVRKLGERVLPSIIPILSQGLKDPSASRRQGVCIGLSEVMGSAGKHQLLSFMDELIPTIRTALCDSTQEVRESAGLAFSTLYKSAGLQAIDEIVPTLLRALEDDDTSATALDGLKQILSVRTAAVLPHILPKLVQPPLSSFNAHALGALAEVAGPGLNSHIGTVLPALILAMDDEDADVQNSARKAAETVLLVIDEEGVETLIPELLRGINDSQASMRRGSAYLIGFLFKNTKLYLADEASDMMSTLIILLSDTDKATVSAALEAFSRVVASVPKEQLPTHIKLVRDAVSTARDKERRRRKGVPILVPGLCLPKALQPFLPIYQQGLISGSAETKEQAAEGLGELIDVTSEKTLKEVVVPITGPLIRILGDRFPWQVKSAILSTLTIIIMKGGIALKPFLPQLQTTFVKCLQDNNRSVRARAAAALGKLSALSTRVDPLVSDLLSMLQSGDESVKESVLSALKGVIKHAGKSVSSAIRSRGCALLEDLLQAEADDVRSCAAKVIGTLSQYMEETEISDLVQILLNMSTSSDWCTRHGALLSFSYISMHSPSKLCHLASFPSLVDLLKGSLKDDKFPVREVATRTLGKILCFELQPEAGTLQLVQLLILALRDDSSEVRRRSLSCIKAAAKTNHSALATHHSILGPAIAEALKDSSMPVRLAAERCALHVFQLTKGPDNVTAAQKYLGMTGLEVKKIAKLDVDSDGSESSDDDKRTX

SEQ ID NO: 10048 - protein, 464 aa, Zea mays
  misc_feature (464)..(464): Xaa can be any naturally occurring amino acid
  unsure (1)..(464): unsure at all Xaa locations
LRTEKGEDGQRIGIEKHLRSPPPPSLLLLRPSPSVASTPKMDKLSGSARLMIVSDLDHTMVDHHDEENLSLLRFGALWESVYCEDSLLVFSTGRSPTLYKELRKEKPMLTPDITIMSVGTEITYGEAMVPDDGWEEYLNNKWDRNIVVAETVSFSELKLQPETEQRPHKVSFFVDKKNAQEVIKSVAERLDKCGLDAKIIYSGGQDLDILPQGAGKGQALAYLLKKLSSCGKPPNNTLVCGDSGNDAELFSIPGVHGVMVSNAQEELLQWYTENAKDNPKIIHSNERCAAGIIQAIGHFKLGPNISPRDLQFPYAKEASFKPTDAVVKFYVLYEKWRRAEVPKSDSVIKYFKNITHANGVTIHPAGLELSLHASIDALGSCYGDKQGRKYRAWVDRLFITQTGSDSWVGRFDLWESEGDVRACSLSSLALILKAESPEGFVLTHIQKTWLNGYSSGVEQAFKLX

SEQ ID NO: 10049 - protein, 122 aa, Zea mays
HHRPDATAPGDGPPRSGPGGPSLVLTADPKPRLRWTADLHERFVDAVAQLGGPEKATPKTILRTMGVKGLTLFHLKSHLQKYRLGKQSDKEGSEQSKDASYLLDAQSGMSVSPRVAAQDMKE

SEQ ID NO: 10050 - protein, 479 aa, Zea mays
  misc_feature (479)..(479): Xaa can be any naturally occurring amino acid
  unsure (1)..(479): unsure at all Xaa locations
EHNAHVRPSSSCTSRGPPLRIRIFFQSKSSAAATKPSPIRTRPFRAISRAMSSSAPAPAAMAVDDAEDDQLASMSTEEITRASRLLDNEIRVHKDELQRSNLELESIKEKTKENQEKIKLNKQLPYLVGNIVEILEMNPEDEAEEDGANIDLDSQRKGKCVVLKTSTRQTIFLPVIGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYAX

SEQ ID NO: 10051 - protein, 284 aa, Zea mays
  misc_feature (284)..(284): Xaa can be any naturally occurring amino acid
  unsure (1)..(284): unsure at all Xaa locations
INRSKSSPAPAAPKSGNPLLRMDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEGEHGETLCGACKESYGPDEFWICCDLCEKWFHGKCVKITAAKAEHIKQYKCPSCTGGGGVGNGGTKRARPSX

SEQ ID NO: 10052 - protein, 378 aa, Zea mays
  misc_feature (378)..(378): Xaa can be any naturally occurring amino acid
  unsure (1)..(378): unsure at all Xaa locations
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSTNSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGQLTESSEKLRLENSALMVKLKDTAEPSPIKASASPSSPRASAENFLSMIDSANAPSVSRHTEHGGPRLRQLLDSSPATDVAAVSX

SEQ ID NO: 10053 - protein, 158 aa, Zea mays; identical to SEQ ID NO: 9900
  misc_feature (158)..(158): Xaa can be any naturally occurring amino acid
  unsure (1)..(158): unsure at all Xaa locations

SEQ ID NO: 10054 - protein, 194 aa, Zea mays
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSGKAAKFVKVAVDGAPYLRKVDLQAYAGYDQLLRALQDKFFSHFTIRKFADDERKLVDAVNGTEYVPTYEDKDGDWMLVGDVPWK

SEQ ID NO: 10055 - protein, 340 aa, Zea mays
  misc_feature (340)..(340): Xaa can be any naturally occurring amino acid
  unsure (1)..(340): unsure at all Xaa locations
MVGTAAGSAEEAVRRWVDAAGGRLVLDGGLATELEANGADLNDPLWSAKCLLSSPHLIRKVHMDYLEAGANIIITASYQATIQGFESKGFSKEQSENLLTKSVEIALEAREMFLKEHLEKSTPIQHPVLVAASLGSYGAYLADGSEYSGDYGEAGTKEFLKDFHRRRLQVLAEAGPNLIAFETIPNKLEAEAYVELLEECNINIPAWFSFNSKDGVHIVSGDSLIECATIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVEX

SEQ ID NO: 10056 - protein, 439 aa, Zea mays
  misc_feature (439)..(439): Xaa can be any naturally occurring amino acid
  unsure (1)..(439): unsure at all Xaa locations
MHIDMIKKPRRFFPFRNLDWRCCLLPVGTVGWGSFQLGYSGNADLEPGRCRRTDGKKWRCSRDAVADQKYCERHMNRGRHRSRKHVEGQPGHAAKAMSAVAVAAAAAAAAALAGAGATAAAGLAANQHRQPGKSYATGATDPCSLQYSRGLANKLSNESENMQDSDSVSMLTSMNTGNTAGSVFPFSKQNTDLFEVSSSRPEFGLVPSDSLTSSPHSSLKSVKNLLSSRSLSEHQSSASLQHFVDWPRTPPAQGGLSWPEAEDMPRAQTSQLSVSAPMASSELSSASTSPIHDHEKLILSPLKLGRDREYSPSGLVSAAANRYEVSQLEATWATTFRDSSTGGPLGEVLAKNNSNAEARSCPSAAPPLTDYYCWDSGHGMQSSPVGVLQRTTAFGSVSSSTGSSPRVESHGACCDGTSNLMDDDLGSVVVSHPSIRLLX

SEQ ID NO: 10057 - protein, 156 aa, Zea mays
  misc_feature (156)..(156): Xaa can be any naturally occurring amino acid
  unsure (1)..(156): unsure at all Xaa locations
MGISSMPEPRDSLLGYLVYNTVISIAALAGLVRAALVFLDLQAALPPGDDGGDQLAASGPGLAERFLRAFRPALYEVLASTATTCEADGGGDDCSVCLAGFRARAVVNRLPCGHLFHRACLETWLRYERATCPLCRAHVPLPADETPLLRYPEFEX

SEQ ID NO: 10058 - protein, 369 aa, Zea mays
  misc_feature (369)..(369): Xaa can be any naturally occurring amino acid
  unsure (1)..(369): unsure at all Xaa locations
LGGRKAKPTCSRAGGDSGMERERQAVARNRKVVLRGYIDRAPREEDMELVDGGAVELRVPEGGGGPAVLVKNLYLSCDPYMRGRMRDFRNSYIPPFKPGSPIEGFGVGRVVDSTHPGFSAGDVVSGMTGWEDYSLITKPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYKEEPDLTAALKRHFPEGIDIYFENVGGPMLDAVLLNMRVHGRIAVCGMVSQHGVTAPAGIHNLFSLISKRIEMKGFIQSDYVHLFPQFVDDITRHYRDGKIVYVEDMSVGLESGPASFVGLFSGKNVGKQVVCVSRDX

SEQ ID NO: 10059 - protein, 111 aa, Zea mays
  misc_feature (111)..(111): Xaa can be any naturally occurring amino acid
  unsure (1)..(111): unsure at all Xaa locations
MAATKLQAFWNHPAGPKTIHFWAPTFKWGISIANIADFAKPPEKISYPQQVAVACTGIIWSRYSLVITPKNWNLFSVNVAMAGTGLYQLSRKIRQDYLSGEKDAAPQLQEX

SEQ ID NO: 10060 - protein, 177 aa, Zea mays
  misc_feature (177)..(177): Xaa can be any naturally occurring amino acid
  unsure (1)..(177): unsure at all Xaa locations
EISVLCDAEVGVVVFSSAGKLYDYCSPKTSLSKILEKYQTNSGKILWGEKHKSLSAEIDRIKKENDTMQIELRHLKGEDLNSLQPKDLIMIEEALDNGLTNLNEKLMEHWERRVTNTKMMEDENKLLAFKLHQQDIALSGSMRELELGYHPDRDLAAQMPITFRVQPSHPNLQENNX

SEQ ID NO: 10061 - protein, 343 aa, Glycine max
  misc_feature (343)..(343): Xaa can be any naturally occurring amino acid
  unsure (1)..(343): unsure at all Xaa locations
MTQVRNKQVVLRDYVTGFPKESDMNIVEGTIILKVPEGSNDVLLKNLYLSCDPYMRLLMAKDRSFGDGSFTLASPLKGYGVSQVLESGRPDYKKGDLVWGITKWEEYSLVPSSLIHFKIEHTDVPLSYYTGILGMPGMTAYAGFFEVGSPKKGDTVFVSAASGAVGQLVGQFAKLTGCYVVGSAGSKEKVDLLKNKLGFDEAFNYKEEPDLNAALKRYFPEGIDIYFENVGGKTLDAVLPNMKFHGRIPVCGMISQYNLTQFDGVTNLANLIFKRVKMEGFIATDFYHLYPKFLEFVLPHIREGKVVYVEDIAEGLEKGPAALVGLYTGRNVGKQVVVVTHEX

SEQ ID NO: 10062 - protein, 343 aa, Glycine max
  misc_feature (343)..(343): Xaa can be any naturally occurring amino acid
  unsure (1)..(343): unsure at all Xaa locations
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQEX

SEQ ID NO: 10063 - protein, 461 aa, Glycine max
  misc_feature (461)..(461): Xaa can be any naturally occurring amino acid
  unsure (1)..(461): unsure at all Xaa locations
SFQIPTTTHTHCRSQSMATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPYX

SEQ ID NO: 10064 - protein, 116 aa, Glycine max
  misc_feature (116)..(116): Xaa can be any naturally occurring amino acid
  unsure (1)..(116): unsure at all Xaa locations
IFYSLGMALSKDISDVKGDKAYGIDTLAIRLGQKWVFWICIILFEMAFGVALLAGATSSYLWIKIVTGLGHAILASILLYQAKSIYLSNKVSTISFYMLIWKLLYAAYFLMALIRX

SEQ ID NO: 10065 - protein, 367 aa, Glycine max
  misc_feature (367)..(367): Xaa can be any naturally occurring amino acid
  unsure (1)..(367): unsure at all Xaa locations
HSHSFTVTLPNPNTFFSLFSFFLASMELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYYYISGFFLTVSPDSIQLVAEHAAANNKIFMMNLSAPFICEFFKGALDKVLPYMDYVFGNETEARTFSKAQGWETDNVEEIALKISQLPKASEKHKRITVITQGADPVCVAEDGKVKLYPVILLPKEKLIDTNGAGDAFVGGFLSQLVKQKPIEECVRAGCYAANVIIQRPGCTYPEKPDFHX

SEQ ID NO: 10066 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10067 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKPIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 10068 - protein, 246 aa, Zea mays
  misc_feature (246)..(246): Xaa can be any naturally occurring amino acid
  unsure (1)..(246): unsure at all Xaa locations
PTMASLFKDPSKLSAYRDRRFKGTQEEYEATLHASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQRELEAQRELVDYGGSFQPNAPPPYERGERKRGYGDSHRNARGDYQRKRYRSSDDRSAPEESKRAPDSDPADKNPRFREKGDSDEEDDDYDKRRRRX

SEQ ID NO: 10069 - protein, 200 aa, Zea mays
  misc_feature (200)..(200): Xaa can be any naturally occurring amino acid
  unsure (1)..(200): unsure at all Xaa locations
AARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 10070 - protein, 257 aa, Zea mays; identical to SEQ ID NO: 10038
  misc_feature (257)..(257): Xaa can be any naturally occurring amino acid
  unsure (1)..(257): unsure at all Xaa locations

SEQ ID NO: 10071 - protein, 262 aa, Zea mays
  misc_feature (262)..(262): Xaa can be any naturally occurring amino acid
  unsure (1)..(262): unsure at all Xaa locations
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELYTLSEESYKDSTLIMQLLRDNLTLWTSDISEDPAEEIREAPKRDSSEGQX

SEQ ID NO: 10072 - protein, 132 aa, Zea mays
  misc_feature (132)..(132): Xaa can be any naturally occurring amino acid
  unsure (1)..(132): unsure at all Xaa locations
MAISSIIAADTSAFLCGRAFGRTPLTNISPKKTLEGALAGLAGCVLTTVLLSTALRWPRSLLSATAYGILIFLGSLFGDLVESLIKRDAGVKDSGSLIPGHGGILDRVDSYVFTGALCYSFVRVALPLYGVX

SEQ ID NO: 10073 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10074 - protein, 246 aa, Zea mays
TNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDE

SEQ ID NO: 10075 - protein, 494 aa, Zea mays
  misc_feature (494)..(494): Xaa can be any naturally occurring amino acid
  unsure (1)..(494): unsure at all Xaa locations
MAGAAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWIX

SEQ ID NO: 10076 - protein, 168 aa, Zea mays
  misc_feature (168)..(168): Xaa can be any naturally occurring amino acid
  unsure (1)..(168): unsure at all Xaa locations
ADKTRPPNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 10077 - protein, 296 aa, Zea mays
  misc_feature (296)..(296): Xaa can be any naturally occurring amino acid
  unsure (1)..(296): unsure at all Xaa locations
AAEAPAMAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAKX

SEQ ID NO: 10078 - protein, 117 aa, Glycine max
  misc_feature (117)..(117): Xaa can be any naturally occurring amino acid
  unsure (1)..(117): unsure at all Xaa locations
MNFFFVGMALAKDIPDVEGDKIYGIDTFAIRIGQKQVFWICIFLFEMAFGVSLVAGATSSSLLVKIITGVGNAVLASVLWFQANSIDLSSKTSGGSFYMLIWKLMYASYFLVALIRX

SEQ ID NO: 10079 - protein, 316 aa, Glycine max
  misc_feature (316)..(316): Xaa can be any naturally occurring amino acid
  unsure (1)..(316): unsure at all Xaa locations
EEERKTMAITLNNGFKMPIIGLGVWRMEGNEIRDLILNSIKIGYRHFDCAADYKNEAEVGDALKEAFDSGLVKREDLFITTKLWNSDQGHVLEACKDSLKKLQLTYLDLYLVHFPVAVRHTGVGNTSSPLGDDGVLDIDTTISLETTWHAMEDLVSSGLVRSIGISNYDIFLTRDCLAYSKIKPAVNQIETHPYFQRDSLVKFCQKHGICVTAHTPLGGAAANAEWFGTVSCLDDQVLKGLAEKYKKTAAQISLRWGIQRNTVVIPKSSKLERLKENFQVFDFELSKEDMELIGSIDRKYRTNQPAVFWGIDLYAX

SEQ ID NO: 10080 - protein, 491 aa, Glycine max
  misc_feature (491)..(491): Xaa can be any naturally occurring amino acid
  unsure (1)..(491): unsure at all Xaa locations
QKMASDKVVETVIAGNYVEMETEGKPKDVKTKLSSLLWHGGSVYDAWFSCASNQVAQVLLTLPYSFSQLGMLSGILFQIFYGLLGSWTAYLISILYVEYRTRKEREKVNFRNHVIQWFEVLDGLLGKHWRNVGLAFNCTFLLFGSVIQLIACASNIYYINDNLDKRTWTYIFGACCATTVFIPSFHNYRIWSFLGLLMTTYTAWYLTVASLLHGQMEGVKHSGPTKLVLYFTGATNILYTFGGHAVTVEIMHAMWKPQKFKALYLLATLYVLTLTLPSAAAVYWAFGDMLLNHSNAFALLPKSPFRDMAVILMLIHQFITFGFACTPLYFVWEKAIGMHECKSLCKRALVRLPVVIPIWFLAIIFPFFGPINSTVGSLLVSFTVYIIPALAHIFTFRSPSSRQNAVEQPPKFVGRWVGTFIINTFVVVWVLVVGFGFGGWASMVNFIRQIDTFGLFTKCYQCPPPLLPPMPPHQLNATAPSPLHHPHHAHX

SEQ ID NO: 10081 - protein, 322 aa, Glycine max
  misc_feature (322)..(322): Xaa can be any naturally occurring amino acid
  unsure (1)..(322): unsure at all Xaa locations
ERASDKSGVRDSDCKTAPALFLLRSSSMEQYEKVEKIGEGTYGVVYKARDRVTNETIALKKIRLEREDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVPX

SEQ ID NO: 10082 - protein, 367 aa, Glycine max
  misc_feature (367)..(367): Xaa can be any naturally occurring amino acid
  unsure (1)..(367): unsure at all Xaa locations
QSLFLPISSPPLSLFLFCFYFHCSLITTLLVVTMVVLSQPALNQFFLLKTCKPTPLFAGIPVVDLTDPDAKTHIVNACRDFGFFKLVNHGVPLQFMANLENETLGFFKKPQSEKDRAGPPDPFGYGSKRIGPNGDVGWVEYLLLNTNPDVISPKSQFIFREGPQNFRAVVEEYIRAVKNMCYEVLELMAEGLGITQRNVLSRLLKDEKSDSCFRLNHYPPCPEVQALNGRNLVGFGEHTDPQIISVLRSNSTSGLQICLTDGTWVSVPPDQTSFFINVGDTLQVMTNGRFKSVKHRVLADPTKSRLSMIYFGGPPLCEKIAPLPSLMLKGEESFYKEFTWWEYKKAAYASRLADNRLGPFEKSAADX

SEQ ID NO: 10083 - protein, 255 aa, Glycine max
DKSASKSPGIYNSATADNKTGSKVGEYADYGSQKAKETKDATKEKAGEYTDYASQKAKETKDKTMEKAGEYTDYASQKAKETKDKTMEKAGEYTDYASQKAKEAKDKTMEKGGEYKDYAAEKAKEGKDATVNKMGEYKDYTAEKAKEGKDTTLGKLGELKDSAADAAKRAVGYLSGKTEETKEKVSETAEATANKAAEMKEATREKAAGTAEAAKNKAAEVKDRAAETAEAAKNKTAETAEAAKQKTAQAKDNAK

SEQ ID NO: 10084 - protein, 536 aa, Glycine max
  misc_feature (536)..(536): Xaa can be any naturally occurring amino acid
  unsure (1)..(536): unsure at all Xaa locations
LTKAKIKQTKDENTMLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEAGPLDLRGQHFQLLPFGSGRRMCPGVNLATSGMATLLASLIQCFDLQVLGPQGQILKGGDAKVSMEERAGLTVPRAHSLVCVPLARIGVASKLLSX

SEQ ID NO: 10085 - protein, 261 aa, Glycine max
  misc_feature (261)..(261): Xaa can be any naturally occurring amino acid
  unsure (1)..(261): unsure at all Xaa locations
ILETSFHSEFEEINRVLLGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10086 - protein, 622 aa, Glycine max
  misc_feature (622)..(622): Xaa can be any naturally occurring amino acid
  unsure (1)..(622): unsure at all Xaa locations
MMRARFPLLLLGVVFLASVSVSFGIAYWEKQNPSHNKCLRSCNSEKDSYRNQACHARCNLLKVEEEEECEEGQIPRPRPQHPERERQQHGEKEEDEGEQPRPFPFPRPRQPHQEEEHEQKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10087 - protein, 606 aa, Glycine max
  misc_feature (606)..(606): Xaa can be any naturally occurring amino acid
  unsure (1)..(606): unsure at all Xaa locations
MMRARFPLLLLGLVFLASVSVSFGIAYWEKENPKHNKCLQSCNSERDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10088 - protein, 576 aa, Glycine max
  misc_feature (576)..(576): Xaa can be any naturally occurring amino acid
  unsure (1)..(576): unsure at all Xaa locations
ENPKHNKCLQSCNSERDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10089 - protein, 483 aa, Glycine max
  misc_feature (483)..(483): Xaa can be any naturally occurring amino acid
  unsure (1)..(483): unsure at all Xaa locations
RGLVEPINNPTHLSGLLRLATSSFQIPTTTHTHCRSQSMATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPYX

SEQ ID NO: 10090 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10091 - protein, 630 aa, Glycine max
  misc_feature (630)..(630): Xaa can be any naturally occurring amino acid
  unsure (1)..(630): unsure at all Xaa locations
VLKNLRYTMMRARFPLLLLGVVFLASVSVSFGIAYWEKQNPSHNKCLRSCNSEKDSYRNQACHARCNLLKVEEEEECEEGQIPRPRPQHPERERQQHGEKEEDEGEQPRPFPFPRPRQPHQEEEHEQKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10092 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10093 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10094 - protein, 606 aa, Glycine max
  misc_feature (606)..(606): Xaa can be any naturally occurring amino acid
  unsure (1)..(606): unsure at all Xaa locations
MMRARFPLLLLGLVFLASVSVSFGIAYWEKENPKHNKCLQSCNSERDSYRNQACHARCNLLKVEKEECEEGEIPRPRPRPQHPEREPQQPGEKEEDEDEQPRPIPFPRPQPRQEEEYEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10095 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10096 - protein, 561 aa, Glycine max
  misc_feature (561)..(561): Xaa can be any naturally occurring amino acid
  unsure (1)..(561): unsure at all Xaa locations
RDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10097 - protein, 606 aa, Glycine max
  misc_feature (606)..(606): Xaa can be any naturally occurring amino acid
  unsure (1)..(606): unsure at all Xaa locations
MMRARFPLLLLGLVFLASVSVSFGIAYWEKENPKHNKCLQSCNSERDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRETISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10098 - protein, 622 aa, Glycine max; identical to SEQ ID NO: 10086
  misc_feature (622)..(622): Xaa can be any naturally occurring amino acid
  unsure (1)..(622): unsure at all Xaa locations

SEQ ID NO: 10099 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10100 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10101 - protein, 572 aa, Glycine max
  misc_feature (572)..(572): Xaa can be any naturally occurring amino acid
  unsure (1)..(572): unsure at all Xaa locations
HNKCLQSCNSERDSYRNQACHARCNLLKVEKEECEEGEIPRPRPRPQHPEREPQQPGEKEEDEDEQPRPIPFPRPQPRQEEEHEQREEQEWPRKEEKRGEKGSEEEDEDEDEEQDERQFPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10102 - protein, 358 aa, Glycine max
  misc_feature (358)..(358): Xaa can be any naturally occurring amino acid
  unsure (1)..(358): unsure at all Xaa locations
MKERQRWRAEEDALLRSYVKQYGPREWNLVSQRMNTYLNRDAKSCLERWKNYLKPGIKKGSLTEEEQRLVIHLQAKYGNKWKKIAAEVPGRTAKRLGKWWEVFKEKQQREKKEINRIADPINNSKYEHILESFAEKLVKERPSPSFVMAASDGAFLLTDTPAPASSLRPSWLSNSSSAAAIGPSSLSVKLSLSSSTVATPPFSWLPPERGPDNAPFVLGNVSALHGAIPTLSDSMHMSQMVEHCKELGEGHRALATHKKEAAWRLSRVELQLESEKANRRREKIEEFEAKIKALQEEEKAALGRIEAEYREQLAALRRDAENKEQKLAEQWDAKHLRFTRLLEQLGCRAGLLEPNARX

SEQ ID NO: 10103 - protein, 381 aa, Glycine max
  misc_feature (381)..(381): Xaa can be any naturally occurring amino acid
  unsure (1)..(381): unsure at all Xaa locations
QLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10104 - protein, 372 aa, Glycine max
  misc_feature (372)..(372): Xaa can be any naturally occurring amino acid
  unsure (1)..(372): unsure at all Xaa locations
MATPVEPPNGIRTEGKHYYSMWQTLFEFDSKYVPIKPIGRGAYGIVCSSVNRETNEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGSPFSRLYPNAHPLAIDLLAKMLVFDPTKRISVTEALQHPYMAPLYDPNCDPPAVIPIDLDIDEDLGEEMIREMMWKEMLHYHPESAMENAGLCX

SEQ ID NO: 10105 - protein, 276 aa, Glycine max
  misc_feature (276)..(276): Xaa can be any naturally occurring amino acid
  unsure (1)..(276): unsure at all Xaa locations
KQTTMANPEGSSRGSRWSLKGTTALVTGGTRGIGHAVVEELAEFGATVYTCSRNEEELNACLKEWKEKGFSVSGLVCDASSPPHRENLIQQVASAFNGKLNILVNNVGTNVRKPTIEYTAEEYSKLMATNLDSTYHLCQLAYPLLKASGNGSIVSISSVASQTSVGSGAIYAATKAAIDQLTKYFACEWAKDNIRSNGVAPWYTITSLVEPLLANKQLVSEIISRTPIKRMAETHEVSSLVTFLCLPAASYITGQIVSVDGGFTANGFQPSMRISX

SEQ ID NO: 10106 - protein, 262 aa, Glycine max
  misc_feature (262)..(262): Xaa can be any naturally occurring amino acid
  unsure (1)..(262): unsure at all Xaa locations
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAEX

SEQ ID NO: 10107 - protein, 446 aa, Glycine max
  misc_feature (446)..(446): Xaa can be any naturally occurring amino acid
  unsure (1)..(446): unsure at all Xaa locations
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPYX

SEQ ID NO: 10108 - protein, 376 aa, Glycine max
  misc_feature (376)..(376): Xaa can be any naturally occurring amino acid
  unsure (1)..(376): unsure at all Xaa locations
MGSKGKRKEQESIITRVMAHGGRYVQYNVYGNLFEVSSKYVPPIRPVGRGAYGIVCAAVNCDTHEEVAIKKIGNAFDNIIDAKRTLREIKLLRHMDHENIIAIRDIIRPPRKDAFNDVYIVYELMDTDLHQIIRSDQPLNDDHCQYFLYQLLRGLKYVHSANILHRDLKPSNLLLNSNCDLKIADFGLARTTSETDFMTEYVVTRWYRAPELLLNCSEYTSAIDVWSVGCIFGEIMTREPLFPGKDYVHQLRLITELLGSPDDASLGFLRSGNAKRYVRQLPQYRKQNFSARFPNMSPEALDLLEKMLIFDPNKRITVDEALCHPYLSSLHDINDEPVGPGQFNFDFEQPTCTEEHIKELIWRESVKYNPDPPSQX

SEQ ID NO: 10109 - protein, 167 aa, Zea mays
  misc_feature (167)..(167): Xaa can be any naturally occurring amino acid
  unsure (1)..(167): unsure at all Xaa locations
EPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFSTX

SEQ ID NO: 10110 - protein, 174 aa, Zea mays
  misc_feature (174)..(174): Xaa can be any naturally occurring amino acid
  unsure (1)..(174): unsure at all Xaa locations
TRPLSVLPPQLTAVWLSPLFRTRFSLRIPSALSLTKVAMAGRGKAIGSGAAKKATSRSSKAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGSAKAAAGDEDX

SEQ ID NO: 10111 - protein, 610 aa, Zea mays
  misc_feature (610)..(610): Xaa can be any naturally occurring amino acid
  unsure (1)..(610): unsure at all Xaa locations
MEWDSDSDGGDDEEEEEVRPGGGDAGPGFSLAIEGVLGACGMVVSDALEPDFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKELARSTWIAPGNTDSPTPVGKGNLWEHSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLVX

SEQ ID NO: 10112 - protein, 333 aa, Zea mays
  misc_feature (333)..(333): Xaa can be any naturally occurring amino acid
  unsure (1)..(333): unsure at all Xaa locations
MSKARVYTDVNVLRPKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRAX

SEQ ID NO: 10113 - protein, 359 aa, Zea mays
  misc_feature (359)..(359): Xaa can be any naturally occurring amino acid
  unsure (1)..(359): unsure at all Xaa locations
ERTDRLLHRSDMAFAPKTSSSSSLSSALQAAQSPPLLLRRMSSTATPRRRYDAAVVVTTTTTARAAAAAVTVPAAPPQAPAPAPVPPKQAAAPAERRSRPVSDTMAALMAKGKTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALPX

SEQ ID NO: 10114 - protein, 249 aa, Zea mays; identical to SEQ ID NO: 10067

SEQ ID NO: 10115 - protein, 158 aa, Zea mays; identical to SEQ ID NO: 9900
  misc_feature (158)..(158): Xaa can be any naturally occurring amino acid
  unsure (1)..(158): unsure at all Xaa locations

SEQ ID NO: 10116 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10117 - protein, 220 aa, Zea mays
  misc_feature (220)..(220): Xaa can be any naturally occurring amino acid
  unsure (1)..(220): unsure at all Xaa locations
ASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPTAFYQQPIIGGALFX

SEQ ID NO: 10118 - protein, 509 aa, Zea mays
  misc_feature (509)..(509): Xaa can be any naturally occurring amino acid
  unsure (1)..(509): unsure at all Xaa locations
EELDREMGLIRTQEETGRHVRMLTHEIRSTLDRHTILKTTLVELGRTLGLEECALWMPSRSGSSLQLSHTLRHQITVGSSVPMNLPVVNQVFSSNRAIIIPHTSSLARVRPLAGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDEHFYLKVQVKDTGCGVSPQDLPHVFTKFAHPQSGGNRGFNGSGLGLAICKRFVSLMGGHIWIDSEGTGRGCTATFVIKLSVCDNTNTYQQQLVPLVWPSSADSNLSAPKVLPDGRGSVSLKSRYQRSVX

SEQ ID NO: 10119 - protein, 400 aa, Zea mays
  misc_feature (400)..(400): Xaa can be any naturally occurring amino acid
  unsure (1)..(400): unsure at all Xaa locations
DEASHAQTESTNVKRPHQPIHFAGDPSHLVASPAPADTGNAAPRSAGRMMMLIDCSGCRTPLQLPHGAPCIRCAICGAVTHIAPAPPAEPNRGAVQPAPGWAPPPPPVHGRKRAVVCGISYRYSRHELKGCINDAKCMRHLLMTRFNFPDDSIIMLNEEQTDPYKIPTKHNIRMAMYWLVQGCQPGDSLVFHYSGHGSQQRNYSGDEVDGFDETLCPLDFETQGMILDDEINTALVRPLPHGVKLHALIDACHSGTALDLPYLCRMNRSGQYVWEDHRPRSGVWKGTSGGEAISFSGCDDDQTSADTSALSKITSTGAMTFCFIQAIERGQGTTYGSILNSMRSTIRNTGDSAGVGGGAVTSLITMLLTGGSLSAGGLRQEPQLTACEPFDVYAKPFSLX

SEQ ID NO: 10120 - protein, 527 aa, Zea mays
  misc_feature (526)..(526): Xaa can be any naturally occurring amino acid
  unsure (1)..(527): unsure at all Xaa locations
ICAISGEVPDEPVVSKKSGLLFERRLIERYIEDHGKCPITKDELTMDDIVPVNTNKVVKPRPLQAASIPGLLGIFQNEWDALMLSNFALEQQLHTARQELSHALYQHDAACRVIARLKKERDEARALLAQAERQIPASVAGAAPAAVVSNGKRAMEDEIGPDGKKIRPGINPVMIDELTECNTMLSAQRKKRQVPPTLAPLDALERYTQISSHPLHKTNKPGILSMDVHPSKDVVATGGIDTNAVIFDRSSGQILCTLTGHSKKITTLKFVPRDQLFVTGSADKTVRIWQENENGNYNCVHTLKDHTAEVEAVTVHATQKYFVSASKDNSWCFYDISTGSCLTQVGEASGQEGYTSASFHPDGLILGTGTTDAVVKIWDVKTQSNVAKFEGHVGPVTAMSFSENGYFLATAAHDGVKLWDLRKLRNFRTFSPYDSDTPTNTVEFDFSGNYLAIGGSDIRVYQVANVKAEWNLIKTLPDLSGTGKVTSVKFGADAKYIAVGSMDRNLRIFGLPGDDQMEESTTAAEXG

SEQ ID NO: 10121 - protein, 215 aa, Zea mays
  misc_feature (215)..(215): Xaa can be any naturally occurring amino acid
  unsure (1)..(215): unsure at all Xaa locations
HKNPRSPQPAAAHAAACTSGVKMSRHPEVKWAQRIDKVYITVQLPDAKDAKVNLEPDGVFTFSGSAGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMGMDDFEDDSDEEEVSKPQAAGHAAEAEKTESAEAKTESAQSSX

SEQ ID NO: 10122 - protein, 340 aa, Zea mays
  misc_feature (340)..(340): Xaa can be any naturally occurring amino acid
  unsure (1)..(340): unsure at all Xaa locations
TPRQPRAQLESTRPSTTPASQSSPPPTTTTPPLAAARSRPIRPDRPAMDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHAX

SEQ ID NO: 10123 - protein, 500 aa, Zea mays
  misc_feature (134)..(134): Xaa can be any naturally occurring amino acid
  misc_feature (167)..(167): Xaa can be any naturally occurring amino acid
  misc_feature (190)..(190): Xaa can be any naturally occurring amino acid
  misc_feature (236)..(236): Xaa can be any naturally occurring amino acid
  misc_feature (276)..(276): Xaa can be any naturally occurring amino acid
  misc_feature (305)..(305): Xaa can be any naturally occurring amino acid
  misc_feature (336)..(336): Xaa can be any naturally occurring amino acid
  misc_feature (363)..(363): Xaa can be any naturally occurring amino acid
  misc_feature (384)..(385): Xaa can be any naturally occurring amino acid
  misc_feature (394)..(394): Xaa can be any naturally occurring amino acid
  misc_feature (412)..(412): Xaa can be any naturally occurring amino acid
  unsure (1)..(500): unsure at all Xaa locations
SVTPRHAHELHSPLRTQPKAPLPWTRAVRRRCSSWAPCWPRRWGGCSWSGGRRRGGGGPRRRGCRRGARGCRSSGRRCGSSRRTSRRTRSRSSTSAWRGTAAGCSRRTCSASAPCSPPTRPSTACCWPRRAAPXAAATRRPSPRCWARGRCCSPRAPRTSASTRSRXPASAARPRRRCWRTSTASSSPPXGAGTAPAPAPCASSTRPRRSPSTSPCGSSSASSLGRGPRASGASTXSSSTASSPSPSPSPPSSRSPSTARPSRRGRRWPELFGRWXGRGWTTRRRTTVAPVRRTGRRRTWWRSSXKRRAGASPWRRWWTSACPCWWLGTRPPPCSXRSPSSSSPRHPPHWRSSRKSTTASEGXKAKAKLWNGAITSRCRLHNAXXAKRCAWPTXSAGCSGVRTPTSTSKATXSQRAARSSRRSEPCTLAWTTTRTPGPSTLGDGSRARASCRARKGPVCSRRSAAGRACARATSSPGWWFPSSSTTSSRALAGRKPRRTG

SEQ ID NO: 10124 - protein, 304 aa, Zea mays
RAGCFHAHGHADPCNSSSTPYMILFGVVQILFSQIPDFDQIWWLSIVAAVMSFTYSSIGLSLGIAQTISNGGFMGSLTGISIGAGVTSTQKIWHTLQAFGDIAFAYSFSNILIEIQDTIKAPPPSESKVMQKATRLSVATTTIFYMLCGCMGYAAFGDKAPDNLLTGFGFFEPFWLIDIANVAIVVHLVGAYQVFCQPIFAFVERRAAAAWPDSAFVSQELRVGPFAVSVFRLTWRSSFVCVTTVVAMLLPFFGNVVGFLGAVSFWPLTVYFPVEMYIKQRRVPRGSTKWICLQTLSVSCLLVS

SEQ ID NO: 10125 - protein, 197 aa, Zea mays
VTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 10126 - protein, 253 aa, Zea mays
  misc_feature (253)..(253): Xaa can be any naturally occurring amino acid
  unsure (1)..(253): unsure at all Xaa locations
HQEWGRGGPHDAGEYKQMPDDTGFFRREGTWSTEYGHFFLAWYSGMLLEHGDRVLAAAEAVFGGTGATLSAKVAGIHWHYRTRSHAAELTAGYYNTRDRDGYAPIARMLAKRGAVLNFTCMEMKDEQQPKHASCSPELLVQQVKTAASAAGVELAGENALERYDEAAFSQVASTARGAALAAFTYLRMNKTLFDGDNWRQFVSFVRAMADGGARPALPRCDTGHSDLYVGFLDAAKKSKAPEAEGAATAAALX

SEQ ID NO: 10127 - protein, 391 aa, Zea mays
  misc_feature (391)..(391): Xaa can be any naturally occurring amino acid
  unsure (1)..(391): unsure at all Xaa locations
MEIDSLREGFDRVAEKRSLSSAKALEVVDQIVNEIEQAIVKLQMMNTDSTGNVDHPSILAELKAKLNEMAPLNQLEGSQKELNVALSKYLKLLEKSFNPDISKAYRNVDFEVHTVNNIIANHFYRQGLFDLGDMFVHECGELGGASLKLPFQEMYAILEAMKARNLEPALSWAAKNHDQLLQNGSMLEFKLYQLQFVEILSKGSRGEAKDEALLYARTHLVPFAAVHKEEFQKLMACLLWVGRLDQSPYSELMSSAHWEKLAEELTHQFCSLLGQSRESPLSVAVSAGFQGLPTLLKLTQVMAAKKQEWQVMKQLPVPIDIGPEFQYHSVFVCPVLREQSSDENPPMRMPCGHVVSKQSIMKLSKSSSRAFKCPYCPSEAMASHCKQLHFX

SEQ ID NO: 10128 - protein, 249 aa, Zea mays; identical to SEQ ID NO: 10067

SEQ ID NO: 10129 - protein, 273 aa, Zea mays
  misc_feature (273)..(273): Xaa can be any naturally occurring amino acid
  unsure (1)..(273): unsure at all Xaa locations
MWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTAKFPLVFIFLLIVLYAIPASAAVLLLYILITVLFALPSFLILYFAYPSLDWLVREIFAX

SEQ ID NO: 10130 - protein, 292 aa, Zea mays
  misc_feature (292)..(292): Xaa can be any naturally occurring amino acid
  unsure (1)..(292): unsure at all Xaa locations
TFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDCX

SEQ ID NO: 10131 - protein, 190 aa, Zea mays
  misc_feature (190)..(190): Xaa can be any naturally occurring amino acid
  unsure (1)..(190): unsure at all Xaa locations
TGRVHAARRLFEYLQANGLNFPVIHHINFPETIDRDGLVIGAGANVGALLVDGLGDGVFLEAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKTVVQRAIAMEGATDALIQLIKDHGRWVDPPAEEX

SEQ ID NO: 10132 - protein, 148 aa, Zea mays
VPQRIVASSEVERSYIMIKPDGVQRGLVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCQ

SEQ ID NO: 10133 - protein, 267 aa, Zea mays
QYMRASLEAAAVASGHEEWGRGGPHDAGEYKQMPDDTGFFRREGTWSTEYGHFFLEWYSGMLLEHGDRVMAAAEAVFGGTGATLSAKVAGIHWHYRTRSHAAELTAGYYNTRGHDGYAPIARMLAKRGAVLNFTCMEMKDEQQPQHASCSPELLVQQVKAATSAAGVQLAGENALERYDDAAFSQVVSTARGAGLAAFTYLRMNKTLFDGDNWGRFVSFVRAMADGGARPALPRCDTGHSDLYVGFVDAAKERKAAEAKGAATTAAL

SEQ ID NO: 10134 - protein, 263 aa, Zea mays
  misc_feature (20)..(20): Xaa can be any naturally occurring amino acid
  misc_feature (27)..(27): Xaa can be any naturally occurring amino acid
  misc_feature (29)..(29): Xaa can be any naturally occurring amino acid
  misc_feature (132)..(132): Xaa can be any naturally occurring amino acid
  misc_feature (137)..(137): Xaa can be any naturally occurring amino acid
  misc_feature (152)..(152): Xaa can be any naturally occurring amino acid
  misc_feature (202)..(202): Xaa can be any naturally occurring amino acid
  unsure (1)..(263): unsure at all Xaa locations
GRVGERPHRHGAHPSIAILXPSPKEPXPXAPPPRSSSRPPGPSSSPLLTAPSSPPRAAPPRSPRSPTLAGRPSPPPTYPTTSRDPTMPRRGGEPSPPQSQLQFTCSRTRRLMLQRWSAPSLPSSLMVSKEAXFLRLXADLREKAISLLPSSXLFHPKNLLRSTTMISRKGLSSVGCVIFSALALCLQWFGKERVSSSMGENXLVPQTHRNLNQEPSGVILPLLLEETSFMEVMAQRQRRMRSLYGLNPRSWSLTPAMRRSGSM

SEQ ID NO: 10135 - protein, 257 aa, Zea mays
  misc_feature (257)..(257): Xaa can be any naturally occurring amino acid
  unsure (1)..(257): unsure at all Xaa locations
ASDLLQHLRSGGARGWRSRRGGAMVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSKX

SEQ ID NO: 10136 - protein, 165 aa, Zea mays
MALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 10137 - protein, 193 aa, Zea mays
  misc_feature (193)..(193): Xaa can be any naturally occurring amino acid
  unsure (1)..(193): unsure at all Xaa locations
IRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 10138 - protein, 378 aa, Zea mays
  misc_feature (378)..(378): Xaa can be any naturally occurring amino acid
  unsure (1)..(378): unsure at all Xaa locations
MANSRIGRYKMSTLSDPSKEDTSPEGSGTTQRNGAWSNTLNTLLQQASVYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLIMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTMKPKAPKVEPKEENDNDEEQQKLLQMQGVQESNPTQKX

SEQ ID NO: 10139 - protein, 351 aa, Zea mays
VVSVMKYCDIFRGEWVPDAEAPYYNHKTCHMIQEHQNCLKYGRPDLGFLKWRWRPSGCELPRFDPLQFLQFARGKSLAFVGDSLARNHMQSLLCLLSQVAYPKDLSANPSDQNKVYHYRAYNFTISMFWSPFLVRAREPDHDGPAHTGHWSLYLDEPDDKWVSQMPRFDYVLVSAANWFSRPSLFYERRRLVGCSFCSRQYGVPDLTLYYSQRRAWRVALRAINDLERLRGRVIVRMLSPMSHFENGTWDHGGDCRRTQPLRANQTAMEGRDLHFYTAQMEEFRAAEKAAAEKGRRLMLMDATAAMLMRPDGHPSRYGHWPNEKVQLYNDCIHWCLPGPIDIWNDMLFQML

SEQ ID NO: 10140 - protein, 631 aa, Zea mays
  misc_feature (631)..(631): Xaa can be any naturally occurring amino acid
  unsure (1)..(631): unsure at all Xaa locations
MKREYQDAGGSGGDMGSSKDKMMTAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAPX

SEQ ID NO: 10141 - protein, 426 aa, Zea mays
  misc_feature (426)..(426): Xaa can be any naturally occurring amino acid
  unsure (1)..(426): unsure at all Xaa locations
MEAAGRLLLLIVSSLLLLFSPERPAEAAPPRIQPLATAALSRLYDTSNYGRLQLNNGLALTPQMGWNSWNFFACNINETVIRETADALVSTGLAALGYNFVNIDDCWSYVKRGKQDQLLPDPKTFPSGVKALADYVHGKGLKLGIYSDAGKFTCQVRPGSLGHENDDAAIFASWGIDYLKYDNCYNLGIKPQKRYPPMRDALNSTGRQIFYSLCEWGQYDPALWAGKVGNSWRTTDDITDTWKSMTDIADKNNKWASYAGPGGWNDPDMLEVGNGGMSLAEYRSHFSIWALMKAPLLIGCDVRNMTSETMEILSNKEVIQVNQDPLGVQGRKILGQGKYGCREVWAGPLSGNRLVVALWNRCSDTANVTMKLPAVGLDGYAAYSVRDLWKHETLSENVVGTFGAQVDVHDTKMYIFSPATIVASVX

SEQ ID NO: 10142 - protein, 401 aa, Zea mays
  misc_feature (85)..(85): Xaa can be any naturally occurring amino acid
  misc_feature (118)..(118): Xaa can be any naturally occurring amino acid
  misc_feature (152)..(152): Xaa can be any naturally occurring amino acid
  misc_feature (160)..(160): Xaa can be any naturally occurring amino acid
  misc_feature (191)..(191): Xaa can be any naturally occurring amino acid
  misc_feature (217)..(217): Xaa can be any naturally occurring amino acid
  misc_feature (244)..(244): Xaa can be any naturally occurring amino acid
  misc_feature (257)..(257): Xaa can be any naturally occurring amino acid
  misc_feature (300)..(300): Xaa can be any naturally occurring amino acid
  misc_feature (372)..(372): Xaa can be any naturally occurring amino acid
  unsure (1)..(401): unsure at all Xaa locations
WLFFLLLMLPRSQLSGLRAMRSALRSHSLRHLSLWTLMGVVCVPSPGPRLTLFWILHGAQLCLSSPTRISTHMSFLSQACLSILXRLSSRPVALPSSCSPFQESLSLLKSCLCHLLLXSTPVGRSSFLAHSQPPTGASLRKLLHLTATLAAXNLVVMLMXLEIQQDLDRSGTSSTPLSTQSNQWLTLRCAXLVWTRRKLVSFSRLMLMGTQHVPRKXQSSLASLKSSPRWRSAILTSNPVATPXMRSMALHSPQSMXRPRTVSATPVTRLWAWMPLLCLMVTLSRGSSGALAPQSFPLPXPSSAGVAMPGHGERHLVQRSMTATTWWSRSCLEAGSSCTRASVLLKTLLLPRPNLFSTALTARTWRVLLLLXRRTTSWLIFSAGRRKRMPWRRRRECLMSK

SEQ ID NO: 10143 - protein, 605 aa, Zea mays
  misc_feature (605)..(605): Xaa can be any naturally occurring amino acid
  unsure (1)..(605): unsure at all Xaa locations
DSDGGDDEEEEEVRPGGGDAGPGFSLAIEGVLGACGMVVSDALEPDFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKELARSTWIAPGNTDSPTPVGKGNLWEHSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLVX

SEQ ID NO: 10144 - protein, 347 aa, Zea mays
  misc_feature (347)..(347): Xaa can be any naturally occurring amino acid
  unsure (1)..(347): unsure at all Xaa locations
MQLTAVDFLEAPVDSRNDDEMWGMEEYHYVLDSKHFGWKPKNESVVLCEDISFGREKVPIVCVIDVDAKDSLGMKPEELLPHGSSLPWEGFHYITNRVMDSSLIDSENSMPGCACSHPECSPENCGHVSLFDGVYNSLVDINGTPMHGRFAYDEDSKIILQEGYPIYECNSSCICDSSCQNKVLQKGLLVKLELFRSENKGWAIRAAEPILQGTFVCEYIGEVVKADKAMKNAESVSSKGGCSYLFSIASQIDRERVRTVGAIEYFIDATRSGNVSRYISHSCSPNLSTRLVLVESKDCQLAHIGLFANQDIAVGEELAYDYRQKLVAGDGCPCHCGTTNCRGRVYX

SEQ ID NO: 10145 - protein, 396 aa, Zea mays
  misc_feature (396)..(396): Xaa can be any naturally occurring amino acid
  unsure (1)..(396): unsure at all Xaa locations
THLSLSLSLSLSLSLVGTWRRGRNREQGGRRGCCDGSSLKFLDPGRQAEKHQLVKMSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDCX

SEQ ID NO: 10146 - protein, 249 aa, Zea mays
  misc_feature (249)..(249): Xaa can be any naturally occurring amino acid
  unsure (1)..(249): unsure at all Xaa locations
LSSPSPDSHLHSPPVHQPLPAMAAAAAQKLLEASTKIIGVGRNYIAHAEELGNPIPKEPVLFLKPTSSFLHAGVATAAVEIPEPLESLHHEVELAVFISRRGRDIPEASAMDFVGGYALALDMTARGLQSVAKSAGLPWTLAKGQDTFTPISAVVPKSSVTNPDDLELWLKVDDELRQKGSTSDMIFKIPFLISYISSIMTLMEGDVILTGTPEGVGPVRVGQKIKAGITDLIDVEFDVQRRNRSFSTX

SEQ ID NO: 10147 - protein, 427 aa, Zea mays
  misc_feature (19)..(19): Xaa can be any naturally occurring amino acid
  misc_feature (34)..(34): Xaa can be any naturally occurring amino acid
  misc_feature (88)..(88): Xaa can be any naturally occurring amino acid
  misc_feature (112)..(112): Xaa can be any naturally occurring amino acid
  misc_feature (194)..(194): Xaa can be any naturally occurring amino acid
  misc_feature (215)..(217): Xaa can be any naturally occurring amino acid
  misc_feature (224)..(224): Xaa can be any naturally occurring amino acid
  misc_feature (241)..(241): Xaa can be any naturally occurring amino acid
  misc_feature (274)..(274): Xaa can be any naturally occurring amino acid
  misc_feature (282)..(282): Xaa can be any naturally occurring amino acid
  misc_feature (298)..(298): Xaa can be any naturally occurring amino acid
  misc_feature (335)..(335): Xaa can be any naturally occurring amino acid
  misc_feature (343)..(343): Xaa can be any naturally occurring amino acid
  misc_feature (388)..(388): Xaa can be any naturally occurring amino acid
  misc_feature (403)..(403): Xaa can be any naturally occurring amino acid
  misc_feature (413)..(413): Xaa can be any naturally occurring amino acid
  unsure (1)..(427): unsure at all Xaa locations
AEMKRRLGWFRPYCSLLAXTPCSRRYSGRAFRSXWAARTSSSGRPSRSSWLDGTATKQTLTRALSSLRRRFRSYLGSVASGATLSNYXVRWQLFLWYHWSGSGSTSLAFQGXRNASKLASQNCSCWLCFLSICLRFWTSASPSSAGSAFSSPSPSCGCTPTSSPSAALTRTLRPRRRCIAALIGRALFQEHLGXVFPIPFSGVLRRLTPEKLSLXXXLRSLLLXSQLAPSSVLRDMRVQLXFLHRLSVGAWDGRALVCCSIHFSGQRTGHRFQXRILDCLRXHALAAGEWCRYLQASXFSSLSLENLELCLRRFRCPYLPACTVSSSHMLVALAXASFSSATXTALGPSSSWGSLSSWAYRFLSTSTSTQPLQAMVRCTLAPDGSMTXSTCHSRRSRSSLGWXPISWTTPSRXRRARCGRTGATTGG

SEQ ID NO: 10148 - protein, 161 aa, Zea mays
  misc_feature (161)..(161): Xaa can be any naturally occurring amino acid
  unsure (1)..(161): unsure at all Xaa locations
MSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10149 - protein, 458 aa, Zea mays
  misc_feature (458)..(458): Xaa can be any naturally occurring amino acid
  unsure (1)..(458): unsure at all Xaa locations
ADKPNSHLAPRIVLSTHLQLRNPTPPAMSSSGAPAPAAAMAVDDAEDDQLASMSTEDIIRASRLLDNEIRVLKDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIVQVQAKKKSSLNYYAX

SEQ ID NO: 10150 - protein, 687 aa, Zea mays
  misc_feature (687)..(687): Xaa can be any naturally occurring amino acid
  unsure (1)..(687): unsure at all Xaa locations
MAAAEARGGEFPVGMKVLVVDDDPTCLVVLKRMLLECRYDVTTCPQATRALTMLRENRRGFDVIISDVHMPDMDGFRLLELVGLEMDLPVIMMSADSRTDIVMNGIKHGACDYLIKPVRMEELKNIWQHVIRKKFNENKDHEHSGSLDDTDRNRPTNNDNEYASSANDGGDGSWKSQRKKREKEDDETDLENGDPSSTSKKPRVVWSVELHQQFVNAVNHLGIDKAVPKKILELMNVPGLTRENVASHLQKFRLYLKRIAQHHAGIPHPFVAPVSSANVAPLGGLEFQALAASGQIPPQALAALQDELLGRPTSSLALPGRDQSSLRVAAIKGNKHHEEREIAFGQPIYKCQNNAYGAFPQNSPAVGGLQPFAAWPNNKVGMTDSTSTLGNVGNSQNSNMLLHELQQQPDTLLLGTLHNIDAKPSGVVMPSQSLNTFPASEGISPNQNPLIIPSQPPSFVSSIPPSMKHESLLGLPSTSTSLLGGLDMVNQASTSQALISSHGTNLPGLMNRSSNAIPSPGISNFQSGNIHYVVNQNAMGVSSKPPGVLKTESTDSLSCSYGYIGGSTSVDSGLFSSQSKNPQYGLLQNQNDVNGSWSPSQDFDSFGNSLGQGHPGTTSSNFQSSALGKLPDQGRGRNHGFVGKGTCIPSRFAVDEVESPTNNLSHSIGNSGDIVNHDIFGFSGHMX

SEQ ID NO: 10151 - protein, 202 aa, Zea mays
  misc_feature (202)..(202): Xaa can be any naturally occurring amino acid
  unsure (1)..(202): unsure at all Xaa locations
AFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSGX

SEQ ID NO: 10152 - protein, 244 aa, Zea mays
  misc_feature (244)..(244): Xaa can be any naturally occurring amino acid
  unsure (1)..(244): unsure at all Xaa locations
QTDELATGMEKVTVSEPEKHGHKEEEHEVVGEKKEGLLAKLHRTSSSSSSSSDEEEEAIDENGEIIKRKKKKMGLKEKLKEKLPGHKDGHHTAAPSPAPAPVETHAHHQEEAHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGGLLGKIMDKIPGYHKSSAEEADHKADAAGEHRTSSX

SEQ ID NO: 10153 - protein, 511 aa, Zea mays
  misc_feature (511)..(511): Xaa can be any naturally occurring amino acid
  unsure (1)..(511): unsure at all Xaa locations
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAANIAMLIVGRMLLGLGLGFSGQATPVYLAEVSPPRWRGGFISAFPLFISVGYLVANLINYGTSRIPGWGWRLSLGLASVPAAVMVVGAAFIPDTPSSLVLRGKHDDARAALQRVRGKGVDIGPEFADILAAAENDRRNEEGAFRRILRREYRPYLVMAVAFPVFLNLTGVAVTAFFSPILFRTVGFESDAALMGAVILGLMNIGGILASGFAMDRYGRKLLFMIGGALMFTCQVAMASIIGSHLGNGSKMPKGYAVTVLVVALIFSASFSWSWGALYWTIPGEIYPVEVRSAGQGAAVALNLGLNFLQAQFFLAMLCCFKYGTFLFYASWLVVMTAFAVAFVPETKGVPLESMAHVFARHWYWGRFVKDHQKLGEESTX

SEQ ID NO: 10154 - protein, 272 aa, Zea mays
  misc_feature (271)..(271): Xaa can be any naturally occurring amino acid
  unsure (1)..(272): unsure at all Xaa locations
LTTSPGSIHAAPTPATARAMDSRVVDGAGGGADASLPADPPSPVPDPAAGGMDARLPSDLLRAVLQRLPPIDLARSACVCRAWRAVASDRAVVEAAFCAPWGVRRVVGEPATGAFWRAASLGRFALSHAIRRGDTVPGVALKYSVQVTDIKRFNNMMSDHGIYSRERLLVPISNPEILLGSTCYIEMDHNAKREVAIFYPEGRPGGKTDSVASIVSAERRNKRILESVRRSLHVDDGTAAYYLSVTEGDPRAAMTEYSEDLRWEQQRAGRXI

SEQ ID NO: 10155 - protein, 348 aa, Zea mays
  misc_feature (348)..(348): Xaa can be any naturally occurring amino acid
  unsure (1)..(348): unsure at all Xaa locations
DVKGDSTGGKRLRASESFQSGVGSKVKLCTNFFSTYGCPFGEGCHFVHYFPGDYRAVSEMTNLGGATIAPPGGMMMDGPPTPIVKTRLCNKYNTAEGCKWGDRCHFAHGESELGKSMMDNYMPPPIGPPPTGYFAPPPMAPPPMAPPPMAPPPMAPLPMAPPPMAPPPMAPPPMAPPPMAPLPMAPPPMAPPPMAPPPMAPPPMAPLPMAPPPMAPPPMANPGLATPASFGAYATAKISVDASLAGGIIGKGGANIKQISSVTGAKVVIQEDRHESDTSLKNIEFEGTFDQIRNASAMVIELIVSISGIGSNFKTKMCENFAKGSCSYGGKCHFAHGESELRKPAAAX

SEQ ID NO: 10156 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10157 - protein, 154 aa, Zea mays; identical to SEQ ID NO: 5911

SEQ ID NO: 10158 - protein, 322 aa, Zea mays
GQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 10159 - protein, 240 aa, Zea mays
  misc_feature (240)..(240): Xaa can be any naturally occurring amino acid
  unsure (1)..(240): unsure at all Xaa locations
MYAKCWSTREAWMVFQQMLERDIIVWNAMIMGLGMIGHEKIAFVLVGQMKNSGVKLNDNTFIGLLCSCTHTSLVNDGRRYFHNMTHVYSISPRIEHYGCMVDLLSRAGLLEEAHQLIGDMPMLANAVVWGARLGGCKIHRNADLAEYVLKQLIRLEPWNSGNYVMLSNIYSNSGRWEDAAKLRLEMKAKGIEKVAASSWVELDDKVHKFYVGDDSHPLSDKIYAKLDELGHGIPCRLSPX

SEQ ID NO: 10160 - protein, 277 aa, Zea mays
LYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 10161 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10162 - protein, 494 aa, Zea mays
  misc_feature (494)..(494): Xaa can be any naturally occurring amino acid
  unsure (1)..(494): unsure at all Xaa locations
ASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10163 - protein, 436 aa, Zea mays
  misc_feature (436)..(436): Xaa can be any naturally occurring amino acid
  unsure (1)..(436): unsure at all Xaa locations
MYVPPPPTGGAGEQPRVYQVWRGSNEFFLQGRFIFGPDVRSVFLTMFLIIAPVVVFCVFVARHLINDFPDSWGISVMVVVVVFTVYDLTLLLCTSGRDPGIIPRNTHPPEPESIDGINDTGVQTPQQFRLPRTKEVVVNGISVRVKYCDTCMLYRPPRCSHCSICNNCVERFDHHCPWVGQCIGLRNYRFFYMFVSSTTLLCLYVFAFCWVYVIKIRAAEHLSIWKALLKTPASIVLIIYCFLCVWFVGGLSVFHLYLMGTNQTTYENFRYRYDRRDNPYNRGTLNNFLEIFCTAIPPSKNNFRARVTVEQGLQQTRSQSRGFMSPSMGKPTIGELEMGRKPVVPWDEPRTAADIRDLEAGFGGMFDEKEGRVAHASPDLSRDLPAEFVEGRTGMHSRQSSWVQRGGDASEASALQMATVHTAEDSNHVPWSGTRX

SEQ ID NO: 10164 - protein, 484 aa, Zea mays
  misc_feature (484)..(484): Xaa can be any naturally occurring amino acid
  unsure (1)..(484): unsure at all Xaa locations
MATSVRGFSSAPCRDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGHRVCAYLDPSEPTHAKVKQLLFSLLLSRKDDVIPVFRSNFSSLLATVESDLAQGGKAEFNKLNDVTSFDFIGEAYFGVRPSATDLGKGGPTKAAKWLIWQLHPLLTLGLPMVLEEPLLHTFHLPPFLVKGDYGALYKYFSTVAKQALDTAEGLGLSREEACHNLLFATTFNSYGGLKVLFPGILANVASAGEKLHERLVAEIRGAVAEAGGKVTLAAVEKMELVKSVVWESLRLDPPVKFQYGHAKKDLQVQSHDAVFQVKKGEMLFGYQPCATKDPRVFGATAKEFVPGRFLGEEGSKLLQYVYWSNGRETENPTVDNKQCPGKNFVVLVGRLFLVELFLRYDTFTADIGKDLLGSSVVFTSVTKATSGPGSEX

SEQ ID NO: 10165 - protein, 164 aa, Zea mays
  misc_feature (164)..(164): Xaa can be any naturally occurring amino acid
  unsure (1)..(164): unsure at all Xaa locations
RPPNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 10166 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10167 - protein, 149 aa, Zea mays; identical to SEQ ID NO: 5266

SEQ ID NO: 10168 - protein, 485 aa, Zea mays
  misc_feature (485)..(485): Xaa can be any naturally occurring amino acid
  unsure (1)..(485): unsure at all Xaa locations
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRGKSTDEMKKGAFDAASLQRLVNGKSDGGVTPLHLAALHGHAESVQLLLDLGASVSEVTVNDGSTIDLIGSGSTPLHYAACGGSAVCCQLLIAAGANMGAQNVNGLTPLLVARSWHKTSIEGILSKQPENRMRILPSPYLCLPLMSIVKIARECGWRKTSASSTCQDPCVICLEVECTVAAEGCGHEFCTKCALYLCSTTSSSTSTRGVPGSISCPLCRHAIVSFMRLTSTTPIKELPWTSASLALCAAGSNTGRPEHGGSLHRRPDLRRLRSISVQLGCSSFRSIGSGKLSSMKLNCTGAEEAVPCLVSCLRPDVQRSSSYRGRIRRYSEFX

SEQ ID NO: 10169 - protein, 295 aa, Zea mays
  misc_feature (295)..(295): Xaa can be any naturally occurring amino acid
  unsure (1)..(295): unsure at all Xaa locations
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEYFKDLEVVQX

SEQ ID NO: 10170 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10171 - protein, 661 aa, Zea mays
  misc_feature (661)..(661): Xaa can be any naturally occurring amino acid
  unsure (1)..(661): unsure at all Xaa locations
MSREAQKLDCTAAGGGIGVLSLDLLGQVLEHLREPRDRKTCRLVSRAFERAEAAHRRALRVLRREPLPRLLRAFPALERLDLSACASLDDASLAAAVADAGGGLAGLRSVCLARANGVGWRGLEALVAACPKLAAVDLSHCVSAGDREAAALAAASELRDLRLDKCLAVTDMGLAKVAVGCPKLEKLSLKWCREISDIGIDLLAKKCPELRSLNISYLKVGNGSLGSISSLERLEELAMVCCSGIDDEGLELLSKGSDSLQSVDVSRCDHVTSEGLASLIDGRNFLQKLYAADCLHEIGQRFLSKLARLKETLTLLKLDGLEVSDSLLQAIGESCNKLVEIGLSKCSGVTDGGISSLVARCSDLRTIDLTCCNLITNNALDSIADNCKMLECLRLESCSLINEKGLKRIATCCPNLKEIDLTDCGVDDAALQHLAKCSELRILKLGLCSSISDRGIAFISSNCGKLVELDLYRCNSITDDGLAALANGCKRIKLLNLCYCNKITDTGLGHLGSLEELTNLELRCLVRVTGIGISSVAIGCKNLIELDLKRCYSVDDAGLWALARYALNLRQLTISYCQVTGLGLCHLLSSLRCLQDIKMVHLSWVSIEGFEMALRAACGRLKKLKMLCGLKTVLSPELLQMLQACGCRIRWVNKPLVYKDX

SEQ ID NO: 10172 - protein, 312 aa, Zea mays
VYSLDWTPEKNWIVSASQDGRLIVWNALTSQKTHAIKLHCPWVMACAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEDDVNSVKFFPDGHRFGTGSDDGTCRLFDMRTGHQLQVYSREPDRNSNELPTVTSIAFSISGRLLFAGYSNGDCYVWDTLLAEVVLNLGNLQNSHDGRISCLGMSSDGSALCTGSWDKNLKIWAFSGHRKIV

SEQ ID NO: 10173 - protein, 599 aa, Zea mays
  misc_feature (599)..(599): Xaa can be any naturally occurring amino acid
  unsure (1)..(599): unsure at all Xaa locations
MGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVHARGHMLQALKLDKCSGFSTDALRLVARSCRSLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASLX

SEQ ID NO: 10174 - protein, 334 aa, Zea mays
  misc_feature (12)..(12): Xaa can be any naturally occurring amino acid
  misc_feature (258)..(258): Xaa can be any naturally occurring amino acid
  unsure (1)..(334): unsure at all Xaa locations
RLSLSLSVSLSXPRPSRSSKQARPNGASRRRRSCCRGGVQQPGGVVRRDADRLRPRRGRAVAGRVGRLRQGTRRRARQRRLRHRQARRILRLRRQVRRRRVRAHAGEHPEAEQRELGGVPVRQARADGAGLRDAQARRGARVHVLQEPERGHAADGGGAGPGPGAARQGVPLRLHLAHLRAVPLGAHGRHARSQGGGRALLLRPQRAPPALAVARRRTRGHPQHLEGGRLHQGQRRRGGLPHARGRQRREERAVPVVXRAQAARRHRRGQGMQVLHQGLQGQRARLQGRHRRHHRRRRRLRRLPPRQRRQGRLHLPQRGEAPRGPQVLQRLRRH

SEQ ID NO: 10175 - protein, 273 aa, Zea mays
  misc_feature (273)..(273): Xaa can be any naturally occurring amino acid
  unsure (1)..(273): unsure at all Xaa locations
VAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFNX

SEQ ID NO: 10176 - protein, 199 aa, Zea mays
  misc_feature (199)..(199): Xaa can be any naturally occurring amino acid
  unsure (1)..(199): unsure at all Xaa locations
PRSQSSCRAPHVARVSSCRCTRITSIQSTPMAEKKMVTLRSSDHEEFEVEEAVAMKSEIIRLLIEDDCADNAIPLPNVDSKTLALVIEYCNKHVHAAAADDSAAAETSNASSAAGGGDVDLKKWDAEFVKVEQATLFDLILAANYLDIKGLLDLTCQTVADMMKGKSPEEIRRTFNIKNDFTEEEEEEIRRENSWAFDX

SEQ ID NO: 10177 - protein, 653 aa, Zea mays
  misc_feature (653)..(653): Xaa can be any naturally occurring amino acid
  unsure (1)..(653): unsure at all Xaa locations
SVRYPSPTRSLRDAARSDPGRRRRPLSPPAAMAYGDRVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTIAIKSGDVYIPRGVSVPALDKDVLWEFQPTKLGVGDVITGGDLYATVFENTLMQHHVALPPGSMGKISYIAPAGQYNLQDTVLELEFQGIKKKFTMLQTWPVRSPRPVASKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRNGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAAGTDGHKITYSVIKHRLGDLFYRLVSQKFEDPAEGEEALVGKFKKLYDDLTTGFRNLEDEARX

SEQ ID NO: 10178 - protein, 281 aa, Zea mays
  misc_feature (281)..(281): Xaa can be any naturally occurring amino acid
  unsure (1)..(281): unsure at all Xaa locations
FRSSTPAPAAAASSLAHLLLCGSVRRRSRMASAAGGGAAGEGEWLKVSQLRPMVEAQDPNAKAVDNLTLRRFLRARDHDVDKASAMFLKFLKWRREAAPGGSVPEEQVRRELSQDKLCMGGVDRAGRPILVAFAARHFSAGRDMAEFKSFVVYFFDKICARIPRGQEKFLCIVDLKGWGYSNCDVRAYIAAIEILQNYYPERLGKALMIHVPYIFMKAWKMIYPFIDTNTRDKFVFVEDKSLQETLRREIDEGQLPEFLGGKMDVIPLKDYGVQQQPQAVX

SEQ ID NO: 10179 - protein, 193 aa, Zea mays
  misc_feature (193)..(193): Xaa can be any naturally occurring amino acid
  unsure (1)..(193): unsure at all Xaa locations
ETTPPIHSPALPRRPSSPPPAHPPVPSCSPMAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKALX

SEQ ID NO: 10180 - protein, 562 aa, Zea mays
  misc_feature (562)..(562): Xaa can be any naturally occurring amino acid
  unsure (1)..(562): unsure at all Xaa locations
KLGRPGPEEHPSLVVAGQLTSAMARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADIVWRVIVMLGAAPALLTYYWRMKMPETARYTALVAKNAKQAAADMSKVLHTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDRSKTDAGYPAGIGVRNSLFVLAASNMLGFVLTFLVPESKGKSLEEMSGEAEDSEEEPVGARAVRPSETQMVX

SEQ ID NO: 10181 - protein, 530 aa, Zea mays
  misc_feature (530)..(530): Xaa can be any naturally occurring amino acid
  unsure (1)..(530): unsure at all Xaa locations
ENDLSFLRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLELMCMEARKRVAEWEPFSATAEHGEDTDFQFSVDMLGEYSDVVRSPRFNGSGSKVSSFRSPLFKLVESVDEGSDGHEDQNESDRVLYAGWNTSSVPSKAMGHSGNASKSAMNRSADEQLPSSMCFVRLSDMSADEWDVFLEKFQELLKETLHESARAAAGQRMKQRLGTSCKFX

SEQ ID NO: 10182 - protein, 271 aa, Zea mays; identical to SEQ ID NO: 10016
  misc_feature (271)..(271): Xaa can be any naturally occurring amino acid
  unsure (1)..(271): unsure at all Xaa locations

SEQ ID NO: 10183 - protein, 217 aa, Zea mays; identical to SEQ ID NO: 9936
  misc_feature (217)..(217): Xaa can be any naturally occurring amino acid
  unsure (1)..(217): unsure at all Xaa locations

SEQ ID NO: 10184 - protein, 199 aa, Zea mays
  misc_feature (199)..(199): Xaa can be any naturally occurring amino acid
  unsure (1)..(199): unsure at all Xaa locations
ARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 10185 - protein, 291 aa, Zea mays
  misc_feature (291)..(291): Xaa can be any naturally occurring amino acid
  unsure (1)..(291): unsure at all Xaa locations
LESRLERHLIFPSRLPPTRPHHHCCDESERERVGGEAAEMGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVKX

SEQ ID NO: 10186 - protein, 355 aa, Zea mays
MAVLSAAGAPPASAIGFEGYEKRLEITFSEAPVFVDPHGSGLRALSRSQIDSVLDLARKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEE

SEQ ID NO: 10187 - protein, 469 aa, Zea mays
NRLLLLGVDDMDIFKGISLKLLAFEQLLMQHPEWRGRVVLVQIANPARGRGKDVREVQEESDAMVRRINDAFGQPGYQPVILIDQPLQFYERMAYYVVAECCLVTAVRDGMNLIPYEYVIARQGNERIDSILGLGPASRKKSMLVVSEFIGCSPSLSGAIRVNPWNIDSVADAMDYALEMPEGEKVLRHEKHHRYVSTHDVGYWANSFLQDLERICLDHNRRRCWGIGFGLKFRVVALDPNFKKLAVEHLVLAYRRTKKRVILLDYDGTLMPQTSLGKSPTSRTIDMLNSLCRDRNNMVFLVSAKSRMTLNEWFLPCESLGLAAEHGCFLRLRRDAEWETCVPVIDCSWKQIAEPVMKTYTETTDGSTIEDKETAIVWCYEDADPDFGSCQAKELHDHLESVLANEPVSVKAGPNLVEVKPQGVSKGLVAKRILSTTQERGDADDDLPDFVLCVGDDRSDEDMFEVIAA

SEQ ID NO: 10188 - protein, 718 aa, Zea mays
  misc_feature (718)..(718): Xaa can be any naturally occurring amino acid
  unsure (1)..(718): unsure at all Xaa locations
ETSQTLAASCKFQSSGICAMASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEKEEKEKKKKKIKEVSHEWSLVNKQKPIWMRKPEEITKEEYAAFYKSLTNDWEEHLAVKHFSVEGQLEFKAVLFVPKRAPFDLFDTKKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETALLTSGFSLDDPNTFGNRIHRMLKLGLSIDEDEPVEAEAEMPQLEDDAGESKMEEVDX

SEQ ID NO: 10189 - protein, 540 aa, Zea mays
  misc_feature (540)..(540): Xaa can be any naturally occurring amino acid
  unsure (1)..(540): unsure at all Xaa locations
MMRCAATGGGCVASWSGDRRLPAVNPCSVRMPTGNDGWCAGLRSRAADLAGLEMANLRGGVGGLFRASPRYGRLQATAAVDPEDIPLEKVQVKSSGHVLPYVGVACLGAILFGYHLGVVNGALEYLAKDLGIAENAVLQGWVVSTSLAGATLGSFTGGSLADKFGRTRTFILDAVPLALGAFLSATAQDIRTMIIGRLLAGIGIGVSSALVPLYISEISPTEIRGTLGTVNQLFICIGILAALLAGLPLAGNPAWWRTMFGIAVVPSILLAVGMAFSPESPRWLFQQGKVTQAELAVKRLYGKEMVTEIMFDLRASGQSSSESEAGWFDLFSKRYWKVVSVGAALFLFQQLAGINAVVYYSTSVFRSAGIASDVAASALVGAANVFGTMVASSLMDKQGRKSLLITSFSGMGASMLLLALSFTWKALAPYSGTLAVVGTVLYVLSFALGAGPVPALLLPEIFASRIRAKAVALSLGMHWVSNFFIGLYFLSVVSKFGISNVYLGFASVCALAVLYIAGNVVETKGRSLEEIERELSVAEX

SEQ ID NO: 10190 - protein, 262 aa, Zea mays
  misc_feature (262)..(262): Xaa can be any naturally occurring amino acid
  unsure (1)..(262): unsure at all Xaa locations
ATAPARRPSIHRHPLAQSKGTLAMSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 10191 - protein, 460 aa, Zea mays
  misc_feature (460)..(460): Xaa can be any naturally occurring amino acid
  unsure (1)..(460): unsure at all Xaa locations
MDRFKLIKEVGDGTFGSVWRAINKQNGEVVAVKKMKKKYYSFEECMGLREVKSLRRMNHPNIVKLKEVIRENDILYFIMEYMECNLYQLMKDKVKPFSESEVRNWCFQIFQALAYMHQRGYFHRDLKPENLLVSKDVIKLADFGLAREVSSLPPYTEYVSTRWYRAPEVLLQSSAYDSAVDMWAMGAIMAELLTLHPLFPGTSEADEIHKICNVIGSPDEQSWPQGLSLAEAMKYQFPQIKGSQLAEVMTTASSDAIDLISSLCSWDPSKRPKAAEVLQHTFFQGCTCVPLPVRPKASSLPRTPPCVGSKGNSENSVARRFSTGTLSTMKSHSNASAKLNGLSKTGVQRKLNLDRQPSQKGMKPTETSNKLTTNRVPARNSPGNPVLRHSRSLPETGRGAIQKVSSITEKLSQMSVTSRTRSAVKPAAPMMKAGHGKSDFLGKSDDIPPAKRLTRKLVSX

SEQ ID NO: 10192 - protein, 507 aa, Glycine max
  misc_feature (31)..(31): Xaa can be any naturally occurring amino acid
  misc_feature (51)..(51): Xaa can be any naturally occurring amino acid
  misc_feature (58)..(58): Xaa can be any naturally occurring amino acid
  misc_feature (67)..(67): Xaa can be any naturally occurring amino acid
  misc_feature (72)..(72): Xaa can be any naturally occurring amino acid
  misc_feature (74)..(74): Xaa can be any naturally occurring amino acid
  misc_feature (112)..(112): Xaa can be any naturally occurring amino acid
  misc_feature (120)..(120): Xaa can be any naturally occurring amino acid
  misc_feature (128)..(128): Xaa can be any naturally occurring amino acid
  misc_feature (143)..(143): Xaa can be any naturally occurring amino acid
  misc_feature (153)..(153): Xaa can be any naturally occurring amino acid
  misc_feature (166)..(166): Xaa can be any naturally occurring amino acid
  misc_feature (180)..(181): Xaa can be any naturally occurring amino acid
  misc_feature (212)..(212): Xaa can be any naturally occurring amino acid
  misc_feature (214)..(214): Xaa can be any naturally occurring amino acid
  misc_feature (216)..(216): Xaa can be any naturally occurring amino acid
  misc_feature (240)..(240): Xaa can be any naturally occurring amino acid
  misc_feature (247)..(247): Xaa can be any naturally occurring amino acid
  misc_feature (251)..(251): Xaa can be any naturally occurring amino acid
  misc_feature (254)..(254): Xaa can be any naturally occurring amino acid
  misc_feature (265)..(265): Xaa can be any naturally occurring amino acid
  misc_feature (274)..(275): Xaa can be any naturally occurring amino acid
  misc_feature (311)..(311): Xaa can be any naturally occurring amino acid
  misc_feature (329)..(329): Xaa can be any naturally occurring amino acid
  misc_feature (336)..(336): Xaa can be any naturally occurring amino acid
  misc_feature (339)..(339): Xaa can be any naturally occurring amino acid
  misc_feature (349)..(349): Xaa can be any naturally occurring amino acid
  misc_feature (376)..(376): Xaa can be any naturally occurring amino acid
  misc_feature (382)..(382): Xaa can be any naturally occurring amino acid
  misc_feature (416)..(416): Xaa can be any naturally occurring amino acid
  misc_feature (435)..(435): Xaa can be any naturally occurring amino acid
  misc_feature (464)..(464): Xaa can be any naturally occurring amino acid
  misc_feature (486)..(486): Xaa can be any naturally occurring amino acid
  misc_feature (488)..(488): Xaa can be any naturally occurring amino acid
  misc_feature (493)..(493): Xaa can be any naturally occurring amino acid
  unsure (1)..(507): unsure at all Xaa locations
VLNLLSENAVESFASGGTHKDGLHPRAIQAXFLSSDDKDCWHTWPKVTIGXRDFPMSXGRNVCGKVXFFMGXSXIPPRDVGKFKGCYQKYQETLCGYARYRGSRTTSCQQNXAPNFPSGXHIGCLNSXSEQRSYFKSFTCKFXWTFKGCEEWXYYFYWSIPVYWKXNNLSVARGQRSEWXXCHLCHKKFCYSCWVTVYFTCLSNSYRPSHSXQXGXGGNKHLGCSKQYRLPFIIIHQARXRCSPCSXVSLXTRXPQTDPDICKDXKHRGVDTFXXDIARSGWYHPLTWKFGDRSSTREGVFISKSSYLQMXHGWETCCCHTCCGYYDRXPKTYSCXSNXCCQCSVGWQXCNCSWGRNFAGVIPCRDYFHCWKNLCXGRESLXSRFVFQEGCQICWRADDSFGINSFLCGTGSHQGXGFCYYLLYFIWQGCKVDCXVPSNHACDIRCHSSTKDKSTSMDFHWSFXGKAITYCERSFPYACRSTTSSXVXKCNKXINFEGCFRPWQGFW

SEQ ID NO: 10193 - protein, 378 aa, Glycine max
  misc_feature (378)..(378): Xaa can be any naturally occurring amino acid
  unsure (1)..(378): unsure at all Xaa locations
MVESIAATSLLGHRPICGGNLTRDVSVKRKSLNTVRFPTTEFLGGGRIVVSLALPKSDKQDRFVFSSIKALAVELTREAHAYREEKLPNRDTKIDRGFDQRPDSWPPANRADKPSLRNPLLRHERMGCGWLGAIFEWEGVLIEDNPDLEKQAWLALSQEEGKPSPPAFILKRIEGMKNEQAISEVLCWSRDPAQLRRMANRKEEIYQSLQGGIYRFLSGSKEFVSVLMHYKIPMALVSTRPRKALESAIGEIGIEDTFSVIVAAEDVHRGKPDPEMFVYAAQLLNFIPERCIVFGNSNLTVEAAHEARMKCVAVASKHPVYELGAADLVVRRLDELSVVDLKNLADIEMTEFGSVEPEMELEVEKDYGSSSVDDNFWX

SEQ ID NO: 10194 - protein, 507 aa, Glycine max
  misc_feature (507)..(507): Xaa can be any naturally occurring amino acid
  unsure (1)..(507): unsure at all Xaa locations
MSGGGEEGATLEFTPTWVVAAFCTVIVAISLAAERLLHYGGKFLKAKDQKPLYEALQKIKEELMLLGFISLLLTVTQNGITKICVRPSLTLHMLPCNLHDAPANHESHFQTFFPGTARRLLSGEHSTPESASKIGYCSRKHKVPLLSVEALHHLHIFIFVLAVVHVSFSVLTVVFGGARIRQWKHWEDSIAKQNYETDRVLKPKVTQVHQHDFIRGRFAGFGKDSAIVGWLLSFLKQFYGSVTKSDYVTLRHGFIMTHCRTNPKFNFHKYMIRALEDDFKQVVGISWYLWLFVVIFLLLNINGWHTYFWIAFIPVILLLAVGTKLEHIITQLAHEVAEKHAAIEGDLVVQPSDDHFWFHRPRVVLFLIHFILFQNAFEIAFFFWIWVTYGFDSCIMGQVRYIVPRLVIGVFIQVLCSYSTLPLYAIVTQMGTHYKRAIFNDHLQQNIVGWAQKAKKRKGLKADGNPGQGSSQESANTGIQLGSIFKKATAPGDSSSAPKADGISSVX

SEQ ID NO: 10195 - protein, 430 aa, Glycine max
  misc_feature (430)..(430): Xaa can be any naturally occurring amino acid
  unsure (1)..(430): unsure at all Xaa locations
QVVNKTEHPISLQADTLVVLTPDQNKEATSNLLPVNFSGLSKAVKNGDTIFIGQYLFTGSETTSVWLEVSEVNGDDVTCVIKNSATLAGSLYTLHVSQIHIDLPTLDNKDKEVISTWGAQNNIDFLSLSYTRHAEDVRHAREFLSKLGNLKQTQIFAKIENIEGLTHFDEILREADGIILSRGNLGIDLPPEKVFLFQKAAIYKCNMAGKPAVVTRVVDTMTDNLRPTRAEATDVANAVLDGSDAIVLGAETLRGLYPVETISTVGKICAEAEKVYNQDLYFKKAVKFVGEPMTHLESIASSAVRAAIKVKASVIICFTSSGRAARLIAKYRPTMPVISVVIPQLKTNQLRWTFTGAFEARQSLIVRGLFPMLADPRHPAESKSATNESILKVALDHGKAFGIIKAHDRVVVCQKVGDSSVVKIIELDEX

SEQ ID NO: 10196 - protein, 296 aa, Glycine max
  misc_feature (296)..(296): Xaa can be any naturally occurring amino acid
  unsure (1)..(296): unsure at all Xaa locations
AIATETQPQQHKDSSEVSGSAAEQRRWTLNDFDIGKPLGRGKFGHVYLAREKTSNHIVALKVLFKSQLQQSQVVHQLRREVEIQSHLRHPHILRLYGYFYDQKRVYLILEYAPKGELYKELQKCKYFSERRAATYVASLARALIYCHGKHVIHRDIKPENLLIGSQGELKIADFGWSVHTFNRRRTMCGTLDYLPPEMVESVEHDASVDIWSLGVLCYEFLYGVPPFEAKEHSDTYRRIIQVDLKFPPKPIVSSAAKDLISQMLVKDSSQRLPLHKLLEHPWIVQNAEPSGVYRSX

SEQ ID NO: 10197 - protein, 308 aa, Glycine max
  misc_feature (308)..(308): Xaa can be any naturally occurring amino acid
  unsure (1)..(308): unsure at all Xaa locations
MKGSNNRFFTVALVAAWYSSNIGVLLLNKYLLSNYGFKYPIFLTMCHMTACSLLSYVAIAWMKVVPLQSIRSRVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLSSEGEKLNSMNLLLYMSPMAVVFLLPATLIMEENVVGITLALARDDSKIIWYLLFNSALAYFVNLTNFLVTKHTSALTLQVLGNAKGAVAVVVSILIFRNPVSVTGMMGYSLTVFGVILYSEAKKRSKX

SEQ ID NO: 10198 - protein, 319 aa, Zea mays
  misc_feature (319)..(319): Xaa can be any naturally occurring amino acid
  unsure (1)..(319): unsure at all Xaa locations
SFVREGAPSCPHIRSSLPDTDRPLVRSPPSPIPTAMAAAAAAASSSSSSEVPIAARTCVSVGEVAVGAVATGSGDRVAADCGVCAICLDRIALQETALVKGCDHAYCVTCILRWASYKENPLCPQCKHPFEFLSVHRSLDGCLHDYLFEESVCLLLRAAWFEPLIVEAHEEALEEEEFLHQQYQYDDDEDDLDEESYYMNRSPSIRIGNRRWGDNGYIRGGRKEARPVNTDVAAGPSRTPKKKEKAASSSASVSVSGSGSGSGSVSKDVAGRRAKRAQKREAADKAAAEKHLKHLQRLGLRKSPEPVVPEEVGPQVNEX

SEQ ID NO: 10199 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10200 - protein, 371 aa, Zea mays
  misc_feature (371)..(371): Xaa can be any naturally occurring amino acid
  unsure (1)..(371): unsure at all Xaa locations
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDNYGTSIDVWSVGCIFAELLGRKPIFPGTECLNQLKLIVNVLGTMSEADLEFIDNPKARRYIKSLPYTPGVPLVSMYPHAHPLAIDLLQKMLIFDPTKRISVTEALEHPYMSPLYDPSANPPAQVPIDLDIDENISSEMIREMMWQEMLHYHPEVATAISMSX

SEQ ID NO: 10201 - protein, 206 aa, Zea mays
  misc_feature (206)..(206): Xaa can be any naturally occurring amino acid
  unsure (1)..(206): unsure at all Xaa locations
QTTYLVVRKLVSNFVKPQELMEDGSAPRRSTPPTRRSRSAEFHNFSERRRRDKINEKLKALQELLPNCNKTDKVSMLDEAIDYLKSLQLQLQMLVMGKGMSPVVPLELQQYMHYITADPAQLPPLRPSGQQHRQFQITQANPQRQSNVESDFLSQMQNLHSSEPPQNFLRPPKLQLYTPEQRGGLPSTSHNTGWISGSSSYNFMEX

SEQ ID NO: 10202 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10203 - protein, 482 aa, Glycine max
  misc_feature (482)..(482): Xaa can be any naturally occurring amino acid
  unsure (1)..(482): unsure at all Xaa locations
RVLFCFAFSAIIMQALHSPTLRASPLDPLRGPNNAAANRRSSSAKRVFFVSATVAPKVSAPQRQKDPKKRVVITGMGLASVFGNDVEGYYEKLLAGESGITAIDRFDASKFPTRFGGQIRGFSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKERDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFKPX

SEQ ID NO: 10204 - protein, 443 aa, Glycine max
  misc_feature (443)..(443): Xaa can be any naturally occurring amino acid
  unsure (1)..(443): unsure at all Xaa locations
RSREIDFENPPPWDEQQNQNYKAKFMCSYGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSVX

SEQ ID NO: 10205 - protein, 274 aa, Glycine max
  misc_feature (274)..(274): Xaa can be any naturally occurring amino acid
  unsure (1)..(274): unsure at all Xaa locations
LIQILQKKKNTMAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQNX

SEQ ID NO: 10206 - protein, 326 aa, Zea mays
  misc_feature (326)..(326): Xaa can be any naturally occurring amino acid
  unsure (1)..(326): unsure at all Xaa locations
MSNRATHWCYACRRPIRLRGQDIACPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDHX

SEQ ID NO: 10207 - protein, 62 aa, Zea mays
MPVPLAPYPAPPAPFTPPNGAQSQLVCTGCRNLLMYPAGATSVCCAVCSTVTAVPAPGTPYA

SEQ ID NO: 10208 - protein, 262 aa, Zea mays
  misc_feature (262)..(262): Xaa can be any naturally occurring amino acid
  unsure (1)..(262): unsure at all Xaa locations
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQX

SEQ ID NO: 10209 - protein, 96 aa, Zea mays
KLVLRTIVIMFTTLVAMLVPFFNAVLGLIGALGFWPLSVYFPVSMHMARLNIRRGEIRWWMLQAMSFVCLLISVAASIGSVHDIVHNLKAAAPFNT

SEQ ID NO: 10210 - protein, 508 aa, Zea mays
  misc_feature (508)..(508): Xaa can be any naturally occurring amino acid
  unsure (1)..(508): unsure at all Xaa locations
SLTLVPFPHLPDPIREFSLLCGHGALCGEDLVWTGVQGQGSLAGGLRPLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10211 - protein, 212 aa, Zea mays
  misc_feature (212)..(212): Xaa can be any naturally occurring amino acid
  unsure (1)..(212): unsure at all Xaa locations
MSGIVFCSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGGMGDMAGMGGLGGMGGMGGLGGMGGMGMDDFEDESDDEEEVSKPQAADKAVEAEETESAETKIEAAQSSX

SEQ ID NO: 10212 - protein, 317 aa, Zea mays
  misc_feature (317)..(317): Xaa can be any naturally occurring amino acid
  unsure (1)..(317): unsure at all Xaa locations
MSFLFKSSNGGTTEKIPSPEEQREKINELRKELGEHSSAAIKDFLSDASLARFLRARNWNVQKASKMMKAAVKWRLAFKPENICWDDIAEEAETGKIYRADYKDKHGRTVLVLRPGLENTTSAIGQIKYLVYSLEKAIMNLTEDQEKMVWLTDFQCWTLGSTPLKVTRETVNVLQDCYPERLGLAILYNPPRIFESFWKIVKPFLDHETRKKVKFVYSNDKESQKIMAEVFDMEELDSAFGGKNPATFEYNSYAEQMQDDDKKMGSSHGSANSLLGSAGKEANGADSDASSEASFYSGTDSPTHENGEHSIAKKNGX

SEQ ID NO: 10213 - protein, 528 aa, Zea mays
  misc_feature (528)..(528): Xaa can be any naturally occurring amino acid
  unsure (1)..(528): unsure at all Xaa locations
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDDX

SEQ ID NO: 10214 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 10215 - protein, 365 aa, Zea mays
  misc_feature (365)..(365): Xaa can be any naturally occurring amino acid
  unsure (1)..(365): unsure at all Xaa locations
LLTWESMHISLFNHSALLTPFVSVQAGRIWRMTEAAVTRYWCHGCVRVVEEAMGEEIKCPFCGGGFIEEMIGEEFDGLASQQSERDSSQWGASNNPFEQPRAEADSEDEEDDDDYDDDIGRAFESFIRRHGRPSALRRAFDSIQDDLRADRDSDFSILINAFNQALALQRSVLDADEARDDQGGSSNDDGLMEEYVLGAGLTLLLQYLTENDPSQYGTPPANKEAVDALPTVQIAEAVSCSVCLDDLELGSQAKQMPCEHKFHSPCILPWLELHSSCPVCRFELPSEETEDLDEPSNVDRTENTHEEVRADGPEDDSESSNRAWALVPWFSGLFSTPEPQTVRGAFTDQQTRSTSGTNMNAGESX

SEQ ID NO: 10216 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10217 - protein, 241 aa, Zea mays
LMTELWMEVLPPPYFAGQAAGGWFLPDRRAGPGAWTLEENKMFERALARVDWDAPDRWERVAAMLPGRTASDVAAHYDDLECDVGCIEAGFVPFPCYGSGGGGGASQSAGFTFDWDAGGLGFKRSCYVVGGGKRERGPDQERKKGVPWTEEEHKQFLMGLKKYGRGDWRNISRNFVTSRTPTQVASHAQKYFIRLNSGGKDKRRSSIHDITTVNLPDDDAGGTASASPPSVLTSASAPSST

SEQ ID NO: 10218 - protein, 310 aa, Zea mays
  misc_feature (310)..(310): Xaa can be any naturally occurring amino acid
  unsure (1)..(310): unsure at all Xaa locations
AMAKLWTLLLAAVVVLSLLVSPIACTRKLNKPKPKPGSYRRPVKPKPKPVTGSYKPAPVAARRNHTATPTPSPTVYGPGGWLSGAGATYYGATNGDGSDGGACGYQTAVGKKPFDSMIAAGSTPLYRGGEGCGACYEVKCTTNAACSGQPVTIVITDQSPGGLFPGEVEHFDMSGTAMGAMARPGMADKLRAGGVLRILYRRVPCKYTGVNIAFKVDQGANPYYFDVLIEFEDDDGDLSAVDLMEAGSGVWTPMAHNWGATWRLNNGRKLKAPFGLRLTSDSRRVLVANNAIPAAWKPGKTYRSLVNYPX

SEQ ID NO: 10219 - protein, 613 aa, Zea mays
  misc_feature (613)..(613): Xaa can be any naturally occurring amino acid
  unsure (1)..(613): unsure at all Xaa locations
MATMESLIGLVNRIQRACTVLGDHGGGGGGEGSLWEALPSVAVVGGQSSGKSSVLESIVGRDFLPRGSGIVTRRPLVLQLHKTDGGHEYAEFLHAPRKRFTDFAAVRKEIADETDRITGKTKAISNVPIHLSIYSPHVVNLTLIDLPGLTKVAVEGQPESIVQDIENMVRAYVDKPNCIILAISPANQDIATSDAIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIAMINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRRLIDSSLSYFKGPAEASVDAVHLVLKELVRRSIAATEELKRFPTLQSDIAAAANDSLERFREDGRKTVLRLVEMEASYLTVEFFRKLPTEPEKAADKNTPVSDRYQDNHLRRIGSNVSSYINMVCETLRNTVPKAIVHCQVKEAKRNLLNRFYAHVGSKEKKQLSAMLDEDPALMEKRDALVKRLELYKSARNEIDSVAWKX

SEQ ID NO: 10220 - protein, 328 aa, Zea mays
  misc_feature (328)..(328): Xaa can be any naturally occurring amino acid
  unsure (1)..(328): unsure at all Xaa locations
MEAQNVEVAALVQKITALHADIAKLPSLSPSPDANALFTSLVMACVPPNPVDVTKLSPDVQGMREELIRLCSDAEGHLEAHYADMLAAFDNPLDHLGRFPYFSNYIDLSKLEFDLLVRYIPGLAPSRVAFVGSGPLPFSSLVLAARHLPNTLFDNYDRCAAANDRARKLVRADKDLNARMSFHTVDVANLTDELAKYDVVFLAALVGMAAEDKAKVVAHLGRHMADGAALVVRSAHGARGFLYPIVDPEDIRRGGFDVLAVYHPDNEVINSVIIARKMDAHTKGLQNGHAHARGTVPIVSPPCKCCKMEANALQKREEMATTTELSIX

SEQ ID NO: 10221 - protein, 402 aa, Zea mays
  misc_feature (402)..(402): Xaa can be any naturally occurring amino acid
  unsure (1)..(402): unsure at all Xaa locations
MSFRSLIQDMKDEFGSISRHSLRSRSHRSAGNAARAAAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACEX

SEQ ID NO: 10222 - protein, 39 aa, Zea mays
NGAGEGGVPTDRPIRVYADGIYDLFHFGHAKSLEQAKKS

SEQ ID NO: 10223 - protein, 241 aa, Zea mays
  misc_feature (241)..(241): Xaa can be any naturally occurring amino acid
  unsure (1)..(241): unsure at all Xaa locations
MMEGGSRADGRNPNQLRPFTCTGNPLHRAHGSARWAQGDTVVLAAVYGPKSGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVESKDTTQRDEESERGLITCITHGAMSEDDYFNCIERGVMASSRISDFMRKTLQKEASRDAX

SEQ ID NO: 10224 - protein, 502 aa, Zea mays
  misc_feature (502)..(502): Xaa can be any naturally occurring amino acid
  unsure (1)..(502): unsure at all Xaa locations
MDTVSVPVVAVANGIGEVERKVQKSYWEEHSKCLTVESMMLDSRAADLDKEERPEILSLLPSYKGKSVLELGAGIGRFTGDLAKEAGHVLALDFIESVIKKNQSINGHHKNITFRCADVTSNDLKIEDNSVDLIFSNWLLMYLSDEEVQKLVGKMVKWLKVGGHIFFRESCFHQSGDSKRKVNPTHYREPRFYTKVFKEGHSFDQDGGSFELSLVTCKCIGAYVKNKKNQNQICWLWEKVKSTEDRDFQRFLDNVQYKTSGILRYERVFGEGFVSTGGIETTKEFVGMLDLKPGQKVLDVGCGIGGGDFYMAANYDVHVLGIDLSVNMVSFAIERAIGRKCSVEFEVADCTTKDYPENSFDVIYSRDTILHIQDKPALFRSFFKWLKPGGKVLISDYCKNPGKPSEEFAAYIKQRGYDLHDVKAYGQMLKDAGFHNVIAEDRTEQFLNVLQRELGEVEKNKDAFLADFTQEDYDDIVNGWNAKLKRSSAGEQRWGLFIATKX

SEQ ID NO: 10225 - protein, 380 aa, Zea mays
  misc_feature (380)..(380): Xaa can be any naturally occurring amino acid
  unsure (1)..(380): unsure at all Xaa locations
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMEDX

SEQ ID NO: 10226 - protein, 459 aa, Zea mays
  misc_feature (459)..(459): Xaa can be any naturally occurring amino acid
  unsure (1)..(459): unsure at all Xaa locations
SFRGLVFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 10227 - protein, 131 aa, Zea mays
FQYSSAHSVLEVSEADHGACSASNPLRSHQGQSTTIPLTKAGTRYFICGAPGHCASGMKVAITVSGGGGGGSSSADNTATPSGPSVRAMNTKPAFGLRSGGATTTDESDSSAAGSGARLAMGLLFGAAGLA

SEQ ID NO: 10228 - protein, 481 aa, Zea mays
  misc_feature (481)..(481): Xaa can be any naturally occurring amino acid
  unsure (1)..(481): unsure at all Xaa locations
MSFRSIVRDVRDGFGSLSRRSFEVTLASIYGLTGHHKGKTQSSSHVLDDSPSIIRESRWANLPPELIRDIIRRLEADESTWPARKHVVCFAAVCRTWREMCKEIVLSPEFCGKLTFPVSLKQPGPRDGNTMVQCFIKRNKSKSTYHLYLCLSNVVTSESGKFLLSAKRHRKTTCTEYTISMDSGNISRSKRTYIGKIRSNFLGTRFLIYDTQAPYNGAVVPPAGRTSRRFNSTKVSPKLPSVSYNIAQVSYELNVLGTRGPRRMRCIMHSIPASSVEPGGTVPGQPEQIVPRALEDSFRSTASFSQSFRSTASFSKSIMDSSMDFNSARFSDIAGSSARFTGVPGSSARFAGVPGSSARFSGIAGARLDNDEESETKERPLVLRNKPPRWHEQLQCWCLNFRGRVTIASVKNFQLIAAATPPPAGAPTPSQPAPSDPDKVILQFGKVARDMFTMDYRYPLSAFQAFAICLSSFDTKLACEX

SEQ ID NO: 10229 - protein, 184 aa, Zea mays
  misc_feature (184)..(184): Xaa can be any naturally occurring amino acid
  unsure (1)..(184): unsure at all Xaa locations
PSSRLRRLIEVNKQGRAMASEHAAGGEAKHDQKQSLMDKAKGFVVEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLFX

SEQ ID NO: 10230 - protein, 334 aa, Zea mays
MAGAQESLSLVGTMRGHNGEVTAIATPIDNSPFIVSSSRDKSLLVWDLTNPVHSTPESGATADYGVPFRRLTGHSHFVQDVVLSSDGQFALSGSWDGELRLWDLSTGLTTRRFVGHEKDVLSVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCTSLSWSADGSTLYTGYTDGSIRVWKISGYGYAG

SEQ ID NO: 10231 - protein, 207 aa, Zea mays
VEAPAAAVAAATPEVATVTEGGAATEAKGPHKLHRQWTFWYDIQSKPKPGAAWGTSLKKAYTFDTVEEFWGLYDHVFRPSKLPGTADFHLFKAGVEPKWEDPECANGGKWTVPCNRKPTFETMWLETLMALVGEQFDETDDICGIVASVRPRGDKLALWTRTASNEAVQVNIGKKWKDVIDYNDKIIYTFHDDSRRDKPSRGGRYTV

SEQ ID NO: 10232 - protein, 223 aa, Zea mays
  misc_feature (223)..(223): Xaa can be any naturally occurring amino acid
  unsure (1)..(223): unsure at all Xaa locations
LSPTGEKPFPSAVSGSLSASKEAVPRSSSELRSEAARKMINLFKIKGQKKDEAASATGKAPVKKQSAGELRLHKDISELNLPKTTSISFPNGKDDLMNFEITIRPDEGYYMGGAFVFTFQVSPSYPHDPPKVKCKTKVYHPNIDLEGNVCLNILREDWKPVLNINTVIYGLNLLFTQPNDEDPLNHEAAAVLRGNPKMFEANVKRAMTGGYVGQHYFQRCLAX

SEQ ID NO: 10233 - protein, 179 aa, Zea mays
  misc_feature (179)..(179): Xaa can be any naturally occurring amino acid
  unsure (1)..(179): unsure at all Xaa locations
RRLIEVNKQGRAMASEHAAGGDAKHHQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLFX

SEQ ID NO: 10234 - protein, 505 aa, Zea mays
  misc_feature (505)..(505): Xaa can be any naturally occurring amino acid
  unsure (1)..(505): unsure at all Xaa locations
PFHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10235 - protein, 359 aa, Zea mays
  misc_feature (359)..(359): Xaa can be any naturally occurring amino acid
  unsure (1)..(359): unsure at all Xaa locations
MPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACEX

SEQ ID NO: 10236 - protein, 500 aa, Zea mays
  misc_feature (500)..(500): Xaa can be any naturally occurring amino acid
  unsure (1)..(500): unsure at all Xaa locations
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDSVVAKKSVLEIEREVAARWRNAVNKKKTGVCX

SEQ ID NO: 10237 - protein, 367 aa, Zea mays
  misc_feature (367)..(367): Xaa can be any naturally occurring amino acid
  unsure (1)..(367): unsure at all Xaa locations
MENGGAKRDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGETDATEWALNYIKEKAPELLSVVACSEVFDSSKGGAEKMCHEMGVPFLGKVPMDPQLCKAAEEGRSCFADQKCSASAPALRNIVKKLIKAEGENSVGLLGNLVVRNEMKX

SEQ ID NO: 10238 - protein, 913 aa, Zea mays
  misc_feature (913)..(913): Xaa can be any naturally occurring amino acid
  unsure (1)..(913): unsure at all Xaa locations
MNPDNFTHKTNEAIVGAHEIAVEAGHAQLTPLHLAAVLAADKGGILRQAITGASGGDGAAGDSFERVLNNSLKKLPSQSPPPDSVPASTALIKVIRRAQSAQKKRGDSHLAVDQLLLGLLEDSQISDCLKEAGVSAARVRAELEKLRGGEGRRVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKAVLKEVEEAEGKVILFIDEIHLVLGAGRTEGSMDAANLFKPMLARGQLRCIGATTLEEYRKYVEKDAAFERRFQQVFVAEPSVPDTVSILRGLKEKYEGHHGVRIQDRALVVAAQLSARYIMGRHLPDKAIDLVDEACANVRVQLDSQPEEIDNLERKRIQLEVELHALEKEKDKASKARLIEVRKELDDLRDKLQPLTMKYRKEKERIDEIRKLKQRREELQFTLQEAERRMDLARVADLKYGALQEIDAAISKLESETGENLMLTETVGPEQIAEVVSRWTGIPVTRLGQNDKERLVGLADRLHQRVVGQTEAVSAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGIALAVTDAALDIILSLSYDPVYGARPIRRWIEKRVVTQLSKMLIQEEIDENCTVYIDAAPGKDELVYRVDRSGGLVNAETGMKSDILIQVPNSSTRSDAAQAVKKMRIMEEDEDGMDEEX

SEQ ID NO: 10239 - protein, 534 aa, Zea mays
  misc_feature (534)..(534): Xaa can be any naturally occurring amino acid
  unsure (1)..(534): unsure at all Xaa locations
MAGGGAAPPPKQEELQPHPVKDQLPSVSYCITSPPPWPEAVILGFQHYIVMLGTSVIIPSALVPQMGGGNEEKARVIQTLLFVAGINTLCQSFFGTRLPAVMGGSYTIVAPTISIIMAGRYSNEADPREKFLRTMRGTQGALIIASTIQIVLGFSGLWRNVVKLLSPLSAVPLVSLAGFGLYELGFPGVAKCVEIGLPEIILMLIFSQYLPHAVHAAKPVFDRFSVIFTIAIVWLYAYILTVSGAYKSARTKTQLHCRVDRSGLVGGAPWISVPYPFQWGAPTFDAGESFAMMVAAFVALVESSGAFIAVSRYASATMIPPSVLGRGIGWQGIGTLLGAFFGTANGTAVSVENAGLLALTHVGSRRVVQISAGFMIFFSVLGKFGAIFASIPLPIFAALYCILFAYIGACGLSFLQFCNLNSFRTKFIMGFSLFMGLSVPQYFNEYTSVAGYGPVHTGARWFNDMINVPFSSKPFVAVLVAFLLDNTIQVRDSGVRRDRGYHWWDKFRSFKTDSRSEEFYSLPFNLNKFFPSVX

SEQ ID NO: 10240 - protein, 763 aa, Zea mays; identical to SEQ ID NO: 9902
  misc_feature (763)..(763): Xaa can be any naturally occurring amino acid
  unsure (1)..(763): unsure at all Xaa locations

SEQ ID NO: 10241 - protein, 458 aa, Zea mays
  misc_feature (458)..(458): Xaa can be any naturally occurring amino acid
  unsure (1)..(458): unsure at all Xaa locations
FRGLVFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 10242 - protein, 185 aa, Zea mays
  misc_feature (185)..(185): Xaa can be any naturally occurring amino acid
  unsure (1)..(185): unsure at all Xaa locations
SPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10243 - protein, 543 aa, Zea mays
  misc_feature (543)..(543): Xaa can be any naturally occurring amino acid
  unsure (1)..(543): unsure at all Xaa locations
VLRTRKPLSVELGPGILGNIFDGIQRPLKTIAIKSGDVYIPRGVSVPALDKDVLWEFQPTKLGVGDVITGGDLYATVFENTLMQHHVALPPGSMGKISYIAPAGQYNLQDTVLELEFQGIKKKFTMLQTWPVRSPRPVASKLAADTPLLTGQRVLDALFPSVLGGTCAIPGAFGCGKTVISQALSKYSNSEAVVYVGCGERGNEMAEVLMDFPQLTMTLPDGREESVMKRTTLVANTSNMPVAAREASIYTGITIAEYFRDMGYNVSMMADSTSRWAEALREISGRLAEMPADSGYPAYLAARLASFYERAGKVKCLGSPDRNGSVTIVGAVSPPGGDFSDPVTSATLSIVQVFWGLDKKLAQRKHFPSVNWLISYSKYSKALESFYEKFDPDFIDIRTKAREVLQREDDLNEIVQLVGKDALAESDKITLETAKLLREDYLAQNAFTPYDKFCPFYKSVWMMRNIIHFNTLANQAVERAAGTDGHKITYSVIKHRLGDLFYRLVSQKFEDPAEGEEALVGKFKKLYDDLTTGFRNLEDEARX

SEQ ID NO: 10244 - protein, 167 aa, Zea mays
  misc_feature (167)..(167): Xaa can be any naturally occurring amino acid
  unsure (1)..(167): unsure at all Xaa locations
LPGRSAFPSFHTVVGRPIALPLLVSVVSAATSATVRDTEMAEGRGSARAIGAMAFAVACCCCCVAIADAATTYYVGDSNGWSFSSPSWPNGKHFRAGDTLVFRYIPWIHNVVAVDEDGYNGCTTPPGSRTYTSGADSVTLARGDNFFICTRFGHCNLGMKLVVYAAX

SEQ ID NO: 10245 - protein, 581 aa, Zea mays
  misc_feature (581)..(581): Xaa can be any naturally occurring amino acid
  unsure (1)..(581): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEHX

SEQ ID NO: 10246 - protein, 161 aa, Zea mays
  misc_feature (161)..(161): Xaa can be any naturally occurring amino acid
  unsure (1)..(161): unsure at all Xaa locations
MSDSEEHHFESNADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10247 - protein, 243 aa, Zea mays
LQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFE

SEQ ID NO: 10248 - protein, 373 aa, Zea mays
  misc_feature (373)..(373): Xaa can be any naturally occurring amino acid
  unsure (1)..(373): unsure at all Xaa locations
ELETSPAQIRKPQISVTSAAASFVSRGEEEMAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAATNNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFNX

SEQ ID NO: 10249 - protein, 454 aa, Zea mays
  misc_feature (454)..(454): Xaa can be any naturally occurring amino acid
  unsure (1)..(454): unsure at all Xaa locations
VFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 10250 - protein, 174 aa, Zea mays
  misc_feature (174)..(174): Xaa can be any naturally occurring amino acid
  unsure (1)..(174): unsure at all Xaa locations
PFPKKPRTQPLTMTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTVX

SEQ ID NO: 10251 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10252 - protein, 425 aa, Zea mays
  misc_feature (425)..(425): Xaa can be any naturally occurring amino acid
  unsure (1)..(425): unsure at all Xaa locations
VNLKEVNHMCPFNTAAFPDSLAIAKEGELSIGTIDDIQKLHIRTIPLNEQARRICHQEQSKTLAFCSFKYNQSVEESETHLIRLLDHQTFESLCVYPLDQYECGCSIISCSFVDDNNVYYCVGTAYVIPEENEPTKGRILVFAVEDGSLQLIVEKETKGAVYSLNAFNGKLLAAINQKIQLYKWMSREDGSHELQSECGHHGHILALYTQTRGDFIVVGDLMKSISLLVYKHEESAIEERARDYNANWMTAVEMLDDEVYVGAENGYNLFTVRKNSDAATDDERAKLEVVGEYHLGEFVNRFRHGSLVMRLPDSEIGKIPTVIFGTINGVIGIIASLPHDHYTFLEKFQSTLVKYIKGVGNMSHEQWRSFHNDKKTAEARNFLDGDLIESFLDLSRSKMEVVSKAMGVSVEDLSKIVEELTRLHX

SEQ ID NO: 10253 - protein, 380 aa, Zea mays
  misc_feature (380)..(380): Xaa can be any naturally occurring amino acid
  unsure (1)..(380): unsure at all Xaa locations
MATAGKVINCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMENX

SEQ ID NO: 10254 - protein, 284 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQA

SEQ ID NO: 10255 - protein, 394 aa, Zea mays
  misc_feature (394)..(394): Xaa can be any naturally occurring amino acid
  unsure (1)..(394): unsure at all Xaa locations
LSLSLSLSLSLSLVGTWRRGRNREQGGRRGCCDGSSLKFLDPGRQAEKHQLVKMSAGFQLGVIGSLALSVASSVAIVICNKALISTLGFPFATTLTSWHLMVTFCTLHVAHRLHFFEPKAIDGQTVILFGLLNGTSIGLLNLSLGFNSIGFYQMTKLAIIPFTVLLETIFLNKRFSESIKLSLLVLLLGVGIASITDLKLNMLGSILSGLAIATTCVGQILTNTIQKRLKVSSTQLLYQSAPYQAGILFATGPFVDQLLTDRSVFAHKYSAPVLGFIVLSCLIAVSVNFSTFLVIGTTSPVTYQVLGHLKTCLVLSFGYTLLHDPFTLRNILGILIAIFGMALYSYFSVREGKKKSANDALPVSQMADKEAEPLLATKDNNDTKKANGLSHDCX

SEQ ID NO: 10256 - protein, 303 aa, Zea mays
  misc_feature (303)..(303): Xaa can be any naturally occurring amino acid
  unsure (1)..(303): unsure at all Xaa locations
MGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDEX

SEQ ID NO: 10257 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 10258 - protein, 407 aa, Zea mays
MGGLEEIKNEAVDLENIPIEEVFEQLKCTREGLSSSEGQQRLEIFGPNRLEEKKESKVLKFLGFMWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRT

SEQ ID NO: 10259 - protein, 536 aa, Zea mays
  misc_feature (536)..(536): Xaa can be any naturally occurring amino acid
  unsure (1)..(536): unsure at all Xaa locations
MPPPLLEFAILATACRFSKPLTVLRRLGVLGPPTVRRNAAEAFVPSPFRQVVVQSGKLLGTPRFCHTTAGMSECLPDVYASQVLKVLKSTSADNTDLSGALHQFAVHMDEDIILMVLQKQRSNWQVALAFFNWAATLPGYAHGSRAYTEMLDILGRMKKVRHMRQLFDEIPEERRQVVVTNKMFAVLLNRYAGAHKVQEAIEVFYLRKDYGFELDLVGFQILLMSLCRYKHVEEAEALFREKKDEFPHVTKSWNIILNGWCVKGSLRDAQRIWNDIIASKVERDLFTFGTFINALAKNGRISAAVKLFKQMWEKGINPDVAICNCIIDQLCFKKKIPEALEIFGEMNDRLCQADVATYNTLIKYMCKIKRMEKVYELLDDMEAKGCPPNNRTYSYILKTTEKPKDVIALMQRMERTGCKLDSDIYNLILNLYIKWKYEKGMQQIWDEMERRGSGPDQRSFTIMVHGLHSQGKLDEALQYYTTMKSRGMIPEPRTKILVKAMHMKKDGAATEDDSASMAGKHLKLDHRSRLFNVHRX

SEQ ID NO: 10260 - protein, 401 aa, Zea mays
  misc_feature (401)..(401): Xaa can be any naturally occurring amino acid
  unsure (1)..(401): unsure at all Xaa locations
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDEX

SEQ ID NO: 10261 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10262 - protein, 295 aa, Zea mays; identical to SEQ ID NO: 10169
  misc_feature (295)..(295): Xaa can be any naturally occurring amino acid
  unsure (1)..(295): unsure at all Xaa locations

SEQ ID NO: 10263 - protein, 234 aa, Zea mays
  misc_feature (234)..(234): Xaa can be any naturally occurring amino acid
  unsure (1)..(234): unsure at all Xaa locations
QAHGSRCPPHVKVGAILSYLSSRSSTSHFPPSSASGTHCLRSACGKILPHSPNMRGAEEERSGTATDAGGEEEKQERSVGLMAGLMDKAKGFVVEKVMQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLFX

SEQ ID NO: 10264 - protein, 349 aa, Glycine max
  misc_feature (349)..(349): Xaa can be any naturally occurring amino acid
  unsure (1)..(349): unsure at all Xaa locations
IFDLPSSETRTKMENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWELPTLASPTGIDPVCMYSAGCEINQLQWSAAQPDWIAIAFANKMQLLKVX

SEQ ID NO: 10265 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10266 - protein, 375 aa, Zea mays; identical to SEQ ID NO: 9956
  misc_feature (375)..(375): Xaa can be any naturally occurring amino acid
  unsure (1)..(375): unsure at all Xaa locations

SEQ ID NO: 10267 - protein, 436 aa, Zea mays
GGKALPLPPGSMGWPYVGETFQLYSSKNPNVFFARKQNRYGPIFKTHILGCPCVMVSSPEAARFVLVTQAHLFKPTFPASKERMLGPQAIFFQQGDYHAHLRRLVSRAFSPEAIRGSVPAIEAIALRSLESWDGRLVNTFQEMKLYALNVALLSIFGEEEMRYIEELKQCYLTLEKGYNSMPVNLPGTLFHKAMKARKRLGAVVAHIIEARREGERQRGSDLLASFLDDREALTDAQIADNVIGVIFAARDTTASVLTWMVKFLGDHPAVLKAVIEEQQEIARSKGSSGEPLTWADTRRMRTTSRVIQETMRVASILSFTFREAVEDVEYQGYLIPKGWKVMPLFRNIHHSPDHFPCPEKFDPSRFEVAPKPNTFLPFGNGTHSCPGNELAKLEMLVLFHHLATKYRWSTSKSESGVQFGPFALPLNGLPMTFVRK

SEQ ID NO: 10268 - protein, 903 aa, Zea mays
  misc_feature (903)..(903): Xaa can be any naturally occurring amino acid
  unsure (1)..(903): unsure at all Xaa locations
GAVAEFAPPPAMASSSKASDSSQRSKRSDQGMGKDAAAASVVPIHANLTQLIRQVQSGRLAYIKEKLEVNRKTLQRHSCSLFDVAAAAEVASRGTDGGNALSQRAAERQCGSDLANGIGERDVVSVQEENLATGTLALSSSGATAQRTIVRFVKLPLVEKIPPYTTWIFLDKNQRMADDQSVVGRRRIYYDTVGNEALICSDSDEEIPEPEEEKHFFTKGEDHLIWRATQDHGLNQEVVNVLCQFIGATPSEIEERSEVLFEKNEKHSGSSDKIESRLSLDKTMDAVLDSFDNLFCRRCLVFDCRLHGCSQNLVFPCEKQPYSFDPDENKKPCGHLCYLRWREGFKEMHDDGLAGGATYTMESGTASQRVDVNVMYESEDSNRQKGNIRSMTLVGTSGSKIISSVSAEESTTTPSADISETENVSSDLPPSSLRKHKISKHGPRYREHSPGKRQKVFTSDISFEGNIMNKLSIPEIRDTRLESRESGGDKLRILDESTKKTSRKDMCGESPATTMENVGRQSNKVSSTKNFLESTLSCWSALERDLYLKGIEIFGKNSCLIARNLLSGLKTCIEVANYMYNNGPAMAKRPLLNKSISGDFAENEQDYMEQDMAARTRIYRRRGRNRKLKYTWKSAGHPTVRKRTDDGKQCYTQYSPCACQQMCGKDCPCADKGTCCEKYCGCSKSCKNKFRGCHCAKSQCRSRQCPCFAASRECDPDVCRNCWVSCGDGSLGEPLARGDGYQCGNMKLLLKQQQRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASEELFYDYRYGPDQAPAWARRPEGSKKDEASVSHRRAHKVARX

SEQ ID NO: 10269 - protein, 720 aa, Zea mays
  misc_feature (720)..(720): Xaa can be any naturally occurring amino acid
  unsure (1)..(720): unsure at all Xaa locations
MALSTFSVPRGFLGVPAQDSHFASAVELHVNKLLQARPINLKPRRRPACVSASLSSEREAEYYSQRPPTPLLDTINYPVHMKNLSVKELRQLADELRSDVIFHVSKTGGHLGSSLGVVELTVALHYVFNAPQDRILWDVGHQSYPHKILTGRRDKMPTMRQTNGLAGFTKRAESEYDSFGTGHSSTTISAALGMAVGRDLKGGKNNVVAVIGDGAMTAGQAYEAMNNAGYLDSDMIVILNDNKQVSLPTATLDGPVPPVGALSSALSKLQSSRPLRELREVAKGVTKQIGGSVHELAAKVDEYARGMISGPGSSLFEELGLYYIGPVDGHNIDDLITILNDVKSTKTTGPVLIHVVTEKGRGYPYAERAADKYHGVAKFDPATGKQFKSPAKTLSYTNYFAEALIAEAEQDSKIVAIHAAMGGGTGLNYFLRRFPSRCFDVGIAEQHAVTFAAGLACEGLKPFCAIYSSFLQRGYDQVVHDVDLQKLPVRFAMDRAGLVGADGPTHCGAFDVAYMACLPNMVVMAPSDEAELCHMVATAAAIDDRPSCFRYPRGNGVGVPLPPNYKGTPLEVGKGRILLEGDRVALLGYGSAVQYCLTAASLVQRHGLKVTVADARFCKPLDHALIRSLAKSHEVLITVEEGSIGGFGSHVAQFMALDGLLDGKLKWRPLVLPDRYIDHGSPADQLAEAGLTPSHIAASVFNILGQNREALAIMAVPNAX

SEQ ID NO: 10270 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10271 - protein, 225 aa, Zea mays
  misc_feature (225)..(225): Xaa can be any naturally occurring amino acid
  unsure (1)..(225): unsure at all Xaa locations
MVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKQRNLQSPPEAPPDLNRCVPPWPRSLPAPSNDMDVETELYIGLPGRERSSNRDSDX

SEQ ID NO: 10272 - protein, 269 aa, Zea mays
  misc_feature (269)..(269): Xaa can be any naturally occurring amino acid
  unsure (1)..(269): unsure at all Xaa locations
MSPSEPTREESVYMAKLAEQAERYEEMVEFMERVARYAGGAGGGDELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDAGDEIKEAAAAPKESAPEGQX

SEQ ID NO: 10273 - protein, 209 aa, Zea mays
  misc_feature (209)..(209): Xaa can be any naturally occurring amino acid
  unsure (1)..(209): unsure at all Xaa locations
WLTRTLEQTSKAFRPGGLPVLSPAPPRMAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDELX

SEQ ID NO: 10274 - protein, 304 aa, Zea mays; identical to SEQ ID NO: 9957
  misc_feature (304)..(304): Xaa can be any naturally occurring amino acid
  unsure (1)..(304): unsure at all Xaa locations

SEQ ID NO: 10275 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10276 - protein, 250 aa, Zea mays
  misc_feature (250)..(250): Xaa can be any naturally occurring amino acid
  unsure (1)..(250): unsure at all Xaa locations
SSTTIHQKAKHKPLMPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHSX

SEQ ID NO: 10277 - protein, 149 aa, Zea mays
  misc_feature (39)..(39): Xaa can be any naturally occurring amino acid
  unsure (1)..(149): unsure at all Xaa locations
KTGHEGRNSNKCHISSGRLNSGVTHRALNYDSSARANRXYSNKTLVSMEAGKASKLNCSSLVDPGMKVALPLCHTFREPESDLLLPVLHGVASMDDIPADFHGVVPTNGTGGCLPRPGGPNDPAASQHDVLPLPHHRHHGAGNDVLHQP

SEQ ID NO: 10278 - protein, 304 aa, Zea mays; identical to SEQ ID NO: 9957
  misc_feature (304)..(304): Xaa can be any naturally occurring amino acid
  unsure (1)..(304): unsure at all Xaa locations

SEQ ID NO: 10279 - protein, 301 aa, Zea mays
  misc_feature (301)..(301): Xaa can be any naturally occurring amino acid
  unsure (1)..(301): unsure at all Xaa locations
SLKPSSARRHHTKIYVRINRSKSSPAPAAPKSGNPLLRMDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEDEHGETLCGACKESYGPDEFWICCDLCEKWFHGKCVKITAAKAEHIKQYKCPSCTGGGGVSNSGTKRARPSX

SEQ ID NO: 10280 - protein, 226 aa, Zea mays
  misc_feature (226)..(226): Xaa can be any naturally occurring amino acid
  unsure (1)..(226): unsure at all Xaa locations
VAAPRGVASPAAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPQLTDFIESEFLEEQVEAINKISKYVAQLRRVGKGHGVWHFDQMLLEEEAX

SEQ ID NO: 10281 - protein, 259 aa, Zea mays
  misc_feature (27)..(27): Xaa can be any naturally occurring amino acid
  misc_feature (79)..(79): Xaa can be any naturally occurring amino acid
  misc_feature (92)..(92): Xaa can be any naturally occurring amino acid
  misc_feature (100)..(100): Xaa can be any naturally occurring amino acid
  misc_feature (125)..(125): Xaa can be any naturally occurring amino acid
  misc_feature (201)..(201): Xaa can be any naturally occurring amino acid
  misc_feature (216)..(216): Xaa can be any naturally occurring amino acid
  misc_feature (255)..(255): Xaa can be any naturally occurring amino acid
  unsure (1)..(259): unsure at all Xaa locations
NRLWAFKKDDAELQGSELCGVYIQKLXCSESNKNFRNSSLTRPSIGSIFGPPGMDSPMEPNGRDTHMHTVSSGDPMIPXPSVTSVLSKFPNXISMRTPGXCGSSWTTCLFLARSLLSLSWASGLXKSTKVSSCKIVCHRLQQRSHALLFHQTWGQFFLEKLHLAAGCPGWQSKLRPSLVAVPGPQEREIRRCCCSRNSHGXCLCWCLICIRNFHIXSRVSVSRVVAIDKQRPFTELLFFVDVWKTRHCRNRSSIXPFML

SEQ ID NO: 10282 - protein, 611 aa, Glycine max
  misc_feature (611)..(611): Xaa can be any naturally occurring amino acid
  unsure (1)..(611): unsure at all Xaa locations
KEICRYLYNHQNKDGGWGLHIEGPSTMFGSVLSYITLRLLGEGPNDGQGEMEKARDWILGHGGATYITSWGKMWLSVLGVYEWSGNNPLPPEIWLLPYMLPFHPGRMWCHCRMVYLPMSYLYGKRFVGPISPTVLSLRKELYTVPYHDIDWDQARNLCAKEDLYYPHPLVQDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIEEFGPTIRKAHTYIKNSQVLEDCPGDLNKWYRHISKGAWPFSTGDHGWPISDCTAEGLKAVLLLSKIAPEIVGEPIDVKRLYDSVNVILSLQNEDGGFATYELKRSYNWLEIINPAETFGDIVIDYPYVECTSAAIQALASFRKLYPGHRREEIQHCIDKATTFIEKIQASDGSWYGSWGVCFTYGAWFGVKGLIAAGRSFSNCSSIRKACEFLLSKQLPSGGWGESYLSCQNKVYSNLEGNRSHVVNTGWAMLALIDAGQAKRDSQPLHRAAAYLINSQLEDGDFPQQEIMGVFNKNCMITYAAYRNIFPIWALGEYQSQVLQSRX

SEQ ID NO: 10283 - protein, 226 aa, Zea mays; identical to SEQ ID NO: 10280
  misc_feature (226)..(226): Xaa can be any naturally occurring amino acid
  unsure (1)..(226): unsure at all Xaa locations

SEQ ID NO: 10284 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10285 - protein, 244 aa, Glycine max
  misc_feature (244)..(244): Xaa can be any naturally occurring amino acid
  unsure (1)..(244): unsure at all Xaa locations
MGSCKPSLSLHLNPLPTRPSPSLTRPSLSLTRPSHSRRSFVVKASSSELPLVGNTAPDFEAEAVFDQEFINVKLSDYIGKKYVVLFFYPLDFTFVCPTEITAFSDRHAEFEALNTEILGVSVDSVFSHLAWIQTDRKSGGLGDLNYPLISDVTKSISKSYGVLIPDQGIALRGLFIIDKEGVIQHSTINNLAIGRSVDETKRTLQALQYVQENPDEVCPAGWKPGEKSMKPDPKLSKDYFAAVX

SEQ ID NO: 10286 - protein, 157 aa, Glycine max
  misc_feature (157)..(157): Xaa can be any naturally occurring amino acid
  unsure (1)..(157): unsure at all Xaa locations
LLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10287 - protein, 436 aa, Glycine max
  misc_feature (436)..(436): Xaa can be any naturally occurring amino acid
  unsure (1)..(436): unsure at all Xaa locations
EDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10288 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10289 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10290 - protein, 437 aa, Glycine max
  misc_feature (437)..(437): Xaa can be any naturally occurring amino acid
  unsure (1)..(437): unsure at all Xaa locations
VRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLLGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10291 - protein, 365 aa, Glycine max
  misc_feature (365)..(365): Xaa can be any naturally occurring amino acid
  unsure (1)..(365): unsure at all Xaa locations
PNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10292 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10293 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10294 - protein, 436 aa, Glycine max
  misc_feature (436)..(436): Xaa can be any naturally occurring amino acid
  unsure (1)..(436): unsure at all Xaa locations
RFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLLGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10295 - protein, 365 aa, Glycine max
KPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFY

SEQ ID NO: 10296 - protein, 630 aa, Glycine max; identical to SEQ ID NO: 10091
  misc_feature (630)..(630): Xaa can be any naturally occurring amino acid
  unsure (1)..(630): unsure at all Xaa locations

SEQ ID NO: 10297 - protein, 345 aa, Glycine max
  misc_feature (345)..(345): Xaa can be any naturally occurring amino acid
  unsure (1)..(345): unsure at all Xaa locations
KTVFQNPNTLSLPMALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGSX

SEQ ID NO: 10298 - protein, 437 aa, Glycine max; identical to SEQ ID NO: 10290
  misc_feature (437)..(437): Xaa can be any naturally occurring amino acid
  unsure (1)..(437): unsure at all Xaa locations

SEQ ID NO: 10299 - protein, 622 aa, Glycine max; identical to SEQ ID NO: 10086
  misc_feature (622)..(622): Xaa can be any naturally occurring amino acid
  unsure (1)..(622): unsure at all Xaa locations

SEQ ID NO: 10300 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10301 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10302 - protein, 454 aa, Glycine max
  misc_feature (454)..(454): Xaa can be any naturally occurring amino acid
  unsure (1)..(454): unsure at all Xaa locations
FPFPRPPHQKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10303 - protein, 389 aa, Glycine max
  misc_feature (389)..(389): Xaa can be any naturally occurring amino acid
  unsure (1)..(389): unsure at all Xaa locations
QRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10304 - protein, 338 aa, Glycine max
  misc_feature (338)..(338): Xaa can be any naturally occurring amino acid
  unsure (1)..(338): unsure at all Xaa locations
DHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEEX

SEQ ID NO: 10305 - protein, 215 aa, Glycine max
  misc_feature (215)..(215): Xaa can be any naturally occurring amino acid
  unsure (1)..(215): unsure at all Xaa locations
MASLTVPNHCVPTLLRTHSLNYPSSQNLPLPSAPSNSQFFGLKLSHSSFSTIPSSSSSLKGSIFAKVTKGSKPPNFTLKDQNGKNVSLSNFKGKPVVVYFYPADETPGCTKQACAFRDSYEKFKKAGAVVVGISGDDAASHKAFASKYKLPFTLLSDEGNKVRKEWGVPGDFFGSLPGRETYVLDKNGVVQLVYNNQFQPEKHIGETLKILQSLX

SEQ ID NO: 10306 - protein, 395 aa, Glycine max
  misc_feature (395)..(395): Xaa can be any naturally occurring amino acid
  unsure (1)..(395): unsure at all Xaa locations
MSDHLPREVLTEILSRLPVRSLLRFRSTSKSWKSLIDSQHLNWLHLTRSLTLASNTSLILRVDSDLYQTNFPTLDPPVSLNHPLMCYSNSITLLGSCNGLLCISNVADDIAFWNPSLRQHRILPYLPVPRRRHPDTTLFAARVCGFGFDHKTRDYKLVRISYFVDLHDRSFDSQVKLYTLRANAWKTLPSLPYALCCARTMGVFVGNSLHWVVTRKLEPDQPDLIIAFDLTHDIFRELPLPDTGGVDGGFEIDLALLGGSLCMTVNFHKTRIDVWVMREYNRRDSWCKVFTLEESREMRSLKCVRPLGYSSDGNKVLLEHDRKRLFWYDLEKKEVALVKIQGLPNLNEAMICLGTLVPPYFLPRQICRKPRALGCERPRKTRDDFLSQGFKLTLX

SEQ ID NO: 10307 - protein, 350 aa, Glycine max
  misc_feature (350)..(350): Xaa can be any naturally occurring amino acid
  unsure (1)..(350): unsure at all Xaa locations
NIFDLPSSETRTKMENSTEESHLRSENSVTYESPYPIYGMSFSPSHPHRLALGSFIEEYNNRVDILSFHPDTLSVTPHPSLSFDHPYPPTKLMFHPRKPSPSSSSDLLATSGDYLRLWEIRDNSVDAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWELPTLASPTGIDPVCMYSAGCEINQLQWSAAQPDWIAIAFANKMQLLKVX

SEQ ID NO: 10308 - protein, 260 aa, Glycine max
  misc_feature (260)..(260): Xaa can be any naturally occurring amino acid
  unsure (1)..(260): unsure at all Xaa locations
MSVEKERETQVYLAKLAEQAERYEEMVECMKKVAKLDLDLTVEERNLLSVGYKNVIGARRASWRIMSSIEQKEESKGNEHNVKLIKSYCQKVEEELSKICGDILTIIDQHLIPSSGSAEASVFYYKMKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDNIKAEEAKPSEPEHX

SEQ ID NO: 10309 - protein, 750 aa, Glycine max
  misc_feature (750)..(750): Xaa can be any naturally occurring amino acid
  unsure (1)..(750): unsure at all Xaa locations
MDAYSSGEEVVVKTRKPYTITKQRERWTEEEHNRFLEALKLHGRAWQRIEEHIGTKTAVQIRSHAQKFFTKLEKEALVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPCVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGKKCSSNYEAMQKNLLFVENNEGLLTIGLGQGKLKTHRTGFKPYKRCSMEAKENRVGASSNQGEEQGCKRIRLEGETSTX

SEQ ID NO: 10310 - protein, 261 aa, Glycine max
  misc_feature (261)..(261): Xaa can be any naturally occurring amino acid
  unsure (1)..(261): unsure at all Xaa locations
MACSATSASLFSANPTPLFSPKPSLSLHLNPLPTRPSPSLTRPSLSLTRPSHSRRSFVVKASSSELPLVGNTAPDFEAEAVFDQEFINVKLSDYIGKKYVVLFFYPLDFTFVCPTEITAFSDRHAEFEALNTEILGVSVDSVFSHLAWIQTDRKSGGLGDLNYPLISDVTKSISKSYGVLIPDQGIALRGLFIIDKEGVIQHSTINNLAIGRSVDETKRTLQALQYVQENPDEVCPAGWKPGEKSMKPDPKLSKDYFAAVX

SEQ ID NO: 10311 - protein, 509 aa, Glycine max
EREHPQPHPPHEERGRRERGRQEGEKEEKEQDERELQPRPFPRPEEHEGEQWKGRHRHEDPEERARMRLREAERIEREREEQRVREEEEKLRRREKKEQREEKEEEGQGSEDSHSKRQNNPFHFSSNRFQTLFKNQHGHLRVLQRFDQRSPQLENLRDYRVVELMAKPNTLFLPHHADADFLLLVLSGRALINLVKPDDRDPYYLDRGYAQRIPAGTTVYLVNPDKKKDLRVIKLAIPVNKPGNFEDFFLSSTQDQQSYLQGFSENILEASFNTKFEEINRVLFGGEGRRHQQEGVILELSKEQIRELSKRAKSSSRSTNSFDYEPFYLRGSQISSNNFGKFYEITPEKNPQLRDFDILLNTVDINEGGLLLPHYNSKAIVILMVTEGEANIELVGLKEQQQGEETREVRKYRAELSEDDIFVIPAAYPFVVNATSNLNFVAFGINAENNQRNFLAGSKDNVIRQIQKQVKELAFPAGSAQDIENLIKNQRESYFADAQPLQKEEGKKG

SEQ ID NO: 10312 - protein, 442 aa, Glycine max
  misc_feature (442)..(442): Xaa can be any naturally occurring amino acid
  unsure (1)..(442): unsure at all Xaa locations
YTMMRVRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLLGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10313 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10314 - protein, 478 aa, Glycine max
  misc_feature (478)..(478): Xaa can be any naturally occurring amino acid
  unsure (1)..(478): unsure at all Xaa locations
EEVGVGMGIDVHLVPSDEVGVGMGIDVHLVPHPKEERKQEEDEDEEQQRESEESEDSELRRHKNKNPFLFGSNRFETLFKNQYGRIRVLQRFNQRSPQLQNLRDYRILEFNSKPNTLLLPNHADADYLIVILNGTAILSLVNNDDRDSYRLQSGDALRVPSGTTYYVVNPDNNENLRLITLAIPVNKPGRFESFFLSSTEAQQSYLQGFSRNILEASYDTKFEEINKVLFSREEGQQQGEQRLQESVIVEISKEQIRALSKRAKSSSRKTISSEDKPFNLRSRDPIYSNKLGKFFEITPEKNPQLRDLDIFLSIVDMNEGALLLPHFNSKAIVILVINEGDANIELVGLKEQQQEQQQEEQPLEVRKYRAELSEQDIFVIPAGYPVVVNATSNLNFFAIGINAENNQRNFLAGSQDNVISQIPSQVQELAFPGSAQAVEKLLKNQRESYFVDAQPKKKEEGNKGRKGPLSSILRAFYX

SEQ ID NO: 10315 - protein, 463 aa, Glycine max
  misc_feature (463)..(463): Xaa can be any naturally occurring amino acid
  unsure (1)..(463): unsure at all Xaa locations
HEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10316 - protein, 443 aa, Glycine max
  misc_feature (443)..(443): Xaa can be any naturally occurring amino acid
  unsure (1)..(443): unsure at all Xaa locations
IYTMMRVRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10317 - protein, 148 aa, Glycine max
  misc_feature (148)..(148): Xaa can be any naturally occurring amino acid
  unsure (1)..(148): unsure at all Xaa locations
AIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10318 - protein, 148 aa, Glycine max; identical to SEQ ID NO: 10317
  misc_feature (148)..(148): Xaa can be any naturally occurring amino acid
  unsure (1)..(148): unsure at all Xaa locations

SEQ ID NO: 10319 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10320 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10321 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10322 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10323 - protein, 440 aa, Glycine max
  misc_feature (440)..(440): Xaa can be any naturally occurring amino acid
  unsure (1)..(440): unsure at all Xaa locations
MMRVRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10324 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10325 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10326 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10327 - protein, 452 aa, Glycine max
  misc_feature (452)..(452): Xaa can be any naturally occurring amino acid
  unsure (1)..(452): unsure at all Xaa locations
GKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10328 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10329 - protein, 477 aa, Glycine max
  misc_feature (477)..(477): Xaa can be any naturally occurring amino acid
  unsure (1)..(477): unsure at all Xaa locations
MGGGFRVLHLVRPFLSFLPEVQTADRKVPFREKVIYTVISLFIFLVCSQLPLYGIHSTTGADPFYWMRVILASNRGTVMELGITPIVTSGLVMQLLAGSKIIEVDNNVREDRALLNGAQKLLGILIAVGEAVAYVLSGMYGSVGQLGVGNAILIILQLCFAGIIVICLDELLQKGYGLGSGISLFIATNICENIIWKAFSPTTINSGRGAEFEGAVIALFHLLITRTDKVRALREAFYRQNLPNVTNLLATILIFLIVIYFQGFRVVLPVRSKNARGQQGSYPIKLFYTSNMPIILQSALVSNLYFISQLLHRKYSGNFIVDLLGKWKESEYGGGQSVPVGGIAYYITAPSSLADMAANPFHALFYLVFMLSACALFSKTWIEVSGSSARDVAKQLKEQQMVMPGHRESNLQKELNRYIPTAAAFGGICIGALTVLADFMGAIGSGTGILLAVTIIYQYFETFEKERASELGFFGFX

SEQ ID NO: 10330 - protein, 581 aa, Glycine max
  misc_feature (581)..(581): Xaa can be any naturally occurring amino acid
  unsure (1)..(581): unsure at all Xaa locations
MEGGGVEVDASAFRECLSLSWKNPYVLRLAFSAGIGGLLFGYDTGVISGAILYIRDDFKAVDRKTWLQEAIVSMALAGAIVGAAVGGWINDRFGRRKAILLADTLFFIGSAVMAAATNPSILIVGRVFVGLGVGMASMASPLYISEASPTRVRGALVSLNGFLITGGQFLSYLINLAFTKAPGTWRWMLGAAVVPALIQIVLMMMLPESPRWLFRKGREEEGKEILRKIYPPQEVEAEINTLRESVEIEIKEAEATDNISIVKMLKTKTVRRGLYAGMGLQIFQQFVGINTVMYYSPTIVQLAGFASNRTALLLSLVTSGLNAFGSILSIYFIDRTGRKKLVLFSLCGVVFSLVVLTVVFHQSTTHSPMVSALETSHFNNTCPDYHSAANPGGWDCMKCLKASPNCGFCASGANKLLPGACLISNDTTKDQCHEEDRLWYTVGCPSKFGWLAIVGLALYIIFFSPGMGTVPWVVNSEIYPLRYRGICGGMASTSNWVSNLIVAQSFLSLTQAIGTSWTFMIFIFITIAAIIFVIIFVPETKGLPMEEVEKMLEGRDLNFKFWQRSSHCGEEVPPQKTQSNX

SEQ ID NO: 10331 - protein, 477 aa, Glycine max
  misc_feature (477)..(477): Xaa can be any naturally occurring amino acid
  unsure (1)..(477): unsure at all Xaa locations
TIYPIFSKSKQAPKEREGKFSSMASSRPANVGILAMDIYFPPTCVTQDALEGHDGVSKGKYTIGLGQDCMAFCSEVEDVISMSLTVVTSLLEKFNVDPKQIGHLAVGSETVIDKSKSIKTFLMQVFEASGNTDIEGVDSTNACYGGTAALFNCVNWVESSSWDGRYGLVVCTDTAVYAEGPARPTGGAAAIAMLVGPDAPIAFESKLRGSHMSHAYDFYKPNLASEYPIVDGKLSQTCYLMALDSCYRLYCEKFEKLEGRPFSMSDSDYFVFHSPYNKLVQKSFGRLYFNDFLRNASFVDEVARETLAPYASLSGDESYQSRDLEKANQQAAKHLYDAKVQPSTLIPKQVGNMYTASLYAAFASLLHNKNSSLVGKRVVMFSYGSGLTATMFSFQLQEGQHPFNLSNIVTVMNVSDKLKQRVEIPPEKFVETLKIMEHRYGGKDFVTSKDCSYLTPGTFYLTNVDSMYRRFYAKKDX

SEQ ID NO: 10332 - protein, 340 aa, Glycine max
  misc_feature (340)..(340): Xaa can be any naturally occurring amino acid
  unsure (1)..(340): unsure at all Xaa locations
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEKX

SEQ ID NO: 10333 - protein, 288 aa, Glycine max
  misc_feature (288)..(288): Xaa can be any naturally occurring amino acid
  unsure (1)..(288): unsure at all Xaa locations
MAIQDQNGFFRSQGGPPEEGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEECX

SEQ ID NO: 10334 - protein, 504 aa, Zea mays
  misc_feature (504)..(504): Xaa can be any naturally occurring amino acid
  unsure (1)..(504): unsure at all Xaa locations
TPSLAPAACRGEASALPGAGLGSSSARKMAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGMWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGFX

SEQ ID NO: 10335 - protein, 537 aa, Zea mays
  misc_feature (537)..(537): Xaa can be any naturally occurring amino acid
  unsure (1)..(537): unsure at all Xaa locations
DFDLAATFFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPVGIGRNTKIRNCIIDMNARIGKNVVITNSKGIQEADHPEEGYYIRSGIVVILKNATINDGSVIX

SEQ ID NO: 10336 - protein, 450 aa, Zea mays
  misc_feature (450)..(450): Xaa can be any naturally occurring amino acid
  unsure (1)..(450): unsure at all Xaa locations
MRKFNLMQSQKSRVLGAMSSSLPILPNPLKGSFPRPHNPQHIPMLRQLPDDSMPLCIDTHQSVSLHPRAGVIGVPYSGYTASPLDSVSNLDSQTMAAPFISQSSNFEALQSLSDNTPETHTKAAWFTSSMDVSPLNTDNIAASDVNQIHSIRPAMTSDESATQNDWWADIMNDDWKDILDATATDSHSKAMIQISNSATSLPAVNQSASSHSREICPVASPPNSSNASVAKQRMRWTPELHECFVDAVNQLGGSEKATPKGVLKLMKVDGLTIYHVKSHLQKYRTARYKPDLSEGTSEKRTATEELVLDLKTSMDLTEALRLQMEVQKRLHEQLEIQRKLQLRIEEQGKYLQMMFEKQSQSSTEKVQDPSSRDTTAKPSSNQSQSTNKDSGATMDPNGTGDIARTAELGERSSELGVKQKLVEIESGTEVATGDRSKIYQEKRRKLQDSX

SEQ ID NO: 10337 - protein, 303 aa, Zea mays
  misc_feature (303)..(303): Xaa can be any naturally occurring amino acid
  unsure (1)..(303): unsure at all Xaa locations
RRDGRHRCGLRRELVHWQAGMKKCASELELEAFIRESGEDARAAAGGSSPGCGGSSDPGGSGVFSPGFGFADSDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWPX

SEQ ID NO: 10338 - protein, 234 aa, Zea mays
  misc_feature (234)..(234): Xaa can be any naturally occurring amino acid
  unsure (1)..(234): unsure at all Xaa locations
MAAKIFCFLMLLGLSASVATATIFPQCSQAPIASLLPPYLSPAVSSMCETPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQQQQLLPFSQLADVSPAAFLTQQQLLPFYLHAMPNAGTLLQLQQLLPFNQLALTNPTVFYQQPIIGGALFX

SEQ ID NO: 10339 - protein, 529 aa, Zea mays
FFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 10340 - protein, 255 aa, Glycine max
  misc_feature (255)..(255): Xaa can be any naturally occurring amino acid
  unsure (1)..(255): unsure at all Xaa locations
EAVVAALFMNIYIVGLNQLSDVEIDKINKPYLPLASGEYSFETGVTIVASFSILSFWLGWVVGSWPLFWALFVSFVLGTAYSINVPLLRWKRFAVLAAMCILAVRAVIVQLAFFLHMQTHVYKRPPVFSRPLIFATAFMSFFSVVIALFKDIPDIEGDKVFGIQSFSVCLGQKPVFWTCVTLLEIAYGVALLVGAASPCLWSKIFTGLGHAVLASILWFHAKSVDLKSKASITSFYMFIWKLFYAEYLLIPFVRX

SEQ ID NO: 10341 - protein, 459 aa, Glycine max
  misc_feature (459)..(459): Xaa can be any naturally occurring amino acid
  unsure (1)..(459): unsure at all Xaa locations
QIPTTTHTHCRSQSMATIVSIKARQIFDSRGNPTVEVDLTCSDGTFARAAVPSGASTGIYEALELRDGGSDYLGKGVSKAVDNVNTIIAPALVGKDPTQQTAIDNLMVQQLDGTVNEWGWCKQKLGANAILAVSLAVCKAGAAVLKVPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQKISGDALKDLYKSFVTEYPIVSIEDPFDQDDWEHYAKLTAEVGTNVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPYX

SEQ ID NO: 10342 - protein, 510 aa, Glycine max
  misc_feature (510)..(510): Xaa can be any naturally occurring amino acid
  unsure (1)..(510): unsure at all Xaa locations
WPFVLVSISKSTTTPSLLFSIIIISTPFTLSHSSLESSTAMATAAEKLSALKSAVAGLNEISENEKNGFISLVGRYLSGEAQHVEWSKIQTPTDEVVVPYDTLAPTPEGSSEVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVVEDFLPLPSKGHTDKDGWYPPGHGDVFPSLLNSGKLDALLSQGKEYVFVANSDNLGAIVDLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARENPENPSIELGPEFKKVSNFLGRFKSIPSIVELDSLKVAGDVWFGAGVILKGKVSIVSKPGVKLEVPDGVAIVDKEINGPEDLX

SEQ ID NO: 10343 - protein, 443 aa, Glycine max
  misc_feature (443)..(443): Xaa can be any naturally occurring amino acid
  unsure (1)..(443): unsure at all Xaa locations
IYTMMRVRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLLGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10344 - protein, 345 aa, Glycine max
  misc_feature (345)..(345): Xaa can be any naturally occurring amino acid
  unsure (1)..(345): unsure at all Xaa locations
KIGKSTRRPGSSSKARVYADVNVVRPKEYWDYESLNVQWGEQDDYEVVRKVGRGKYSEVFEGVHCTDGEKCVIKILKPVKKKKIKREIKILQNLCGGPNIVQLLDIVRDQQSKTPSLIFEYVNNTDFKVLYPTLSDYEIRYYIYELLKALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDGLSAYLDKYRIELDPHLAALIGRHSRKPWAKFINVENHHMAVPEAVDFVDKLLRYDHQERPTAKEAMAHPYFNPVRNAESSRTRAHX

SEQ ID NO: 10345 - protein, 437 aa, Glycine max
  misc_feature (437)..(437): Xaa can be any naturally occurring amino acid
  unsure (1)..(437): unsure at all Xaa locations
VRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLLGEEEEQRQQEGVIVELSREQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10346 - protein, 270 aa, Glycine max
  misc_feature (270)..(270): Xaa can be any naturally occurring amino acid
  unsure (1)..(270): unsure at all Xaa locations
MAAEANFDSKSSRWSLQGMTALVTGGSKGIGYAIVEELAQLGATVHTCARNEAELNKSLNEWNTKGYRVTGSVRDVASRAERQDLIARVSNEFNGKLNILVNNVGTNIQKETLDFTEEDFTFLVNTNLESCFHLSQLAHPLLKASEAANIILISSIAGVVASNIVSVVYGATKGAMNQMTKHLACEWAKDNIRTNCVAPGPIRTPLGDKHFKEEKLNNSLIARTPLGRIGEAEEVSSLVAFLCLPAASYITGQTICVDGGFTVNGLYISX

SEQ ID NO: 10347 - protein, 517 aa, Glycine max
  misc_feature (517)..(517): Xaa can be any naturally occurring amino acid
  unsure (1)..(517): unsure at all Xaa locations
LLLSLSFIIETSFQISQSMALHFLLLLLFAVSVVAADEEPFIGVNIGTDLSDMPHPTQVVALLKAQQIRHVRLYDADQAMLLALAKTGIQVAVTVPNEEILAIGQSNSTAANWVSRNVVAHYPATNITAICVGSEVLTTLPNAAKVLVSAIKYIHSALVASNLDRQVKVSTPLSSSIILDSFPPSQAFFNRSLNPVLVPLLDFLQSTGSYLMLNIYPYYDYMQSNGVIPLDYALFKSLPPNKEAVDSNTLLHYTNVFDAMVDAAYFAMAFLNYTNIPVVVTESGWPSKGGSNEPDATVDNANTYNSNLIKHVFNKTGTPKHPGIDVSTYIYELYNEDMKSGPLSEKNWGLFDANGTPIYILHLTESGAVLANDTSNNTFCIAKDGADPKMLQAALDWACGPGKVECSPLLQGQPCYEPDNVIAHANYAFDTYYHKMGKTPDACDFNGVATISTSDPSHGSCLFPGSVGKNGTLGNFTAPSMNSTNSDSSAYKFSCDLRIRSLLMVTGFLLWGVVLLX

SEQ ID NO: 10348 - protein, 356 aa, Glycine max
ATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQL

SEQ ID NO: 10349 - protein, 534 aa, Glycine max
  misc_feature (534)..(534): Xaa can be any naturally occurring amino acid
  unsure (1)..(534): unsure at all Xaa locations
MAGELGVLNALDVAKTQWYHFTAIVIAGMGFFTDAYDLFCISLVTKLLGRLYYTEPGAPKPGSLPPRVQASVTGVALCGTLAGQLFFGWLGDKMGRKRVYGLTLILMVVCSLASGLSFGSTPEGVMASLCFFRFWLGFGIGGDYPLSATIMSEYANKKTRGAFIAAVFAMQGFGILAGGVVALIVSYAYDQKYKLPSYEQNPEASLDPAFDYVWRIVLMFGAVPAALTYYWRMKMPETARYTALVAKNAKQAAADMSKVLQVELEAEEEKVKKLTENESNKYGLFTKEFVKRHGLHLLGTTTTWFLLDIAFYSQNLFQKDIFSAIGWIPPAKEMNAIHEVYKIARAQTLIALCSTVPGYWFTVALIDYMGRFAIQLLGFFFMTVFMFALAIPYDHWSEKENRIGFVVMYSFTFFFANFGPNSTTFVVPAEIFPARLRSTCHGISAAAGKAGAIVGAFGFLYAAQSKDPSKTDAGYPTGIGIKNSLIMLGVINFIGMLFTLLVPESKGKSLEELSGENGENDAEHAVSARTVPVX

SEQ ID NO: 10350 - protein, 439 aa, Glycine max
  misc_feature (439)..(439): Xaa can be any naturally occurring amino acid
  unsure (1)..(439): unsure at all Xaa locations
MRVRFPLLVLLGTVFLASVCVSLKVREDENNPFYFRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10351 - protein, 457 aa, Glycine max
  misc_feature (457)..(457): Xaa can be any naturally occurring amino acid
  unsure (1)..(457): unsure at all Xaa locations
PVIMVQAYRLLVAEMYVQGWDYPLHLGVTEAGEGEDGRMKSAIGIGTLLQDGLGDTIRVSLTEPPEEEIDPCRRLANLGMRASELQKGVEPFEEKHRHYFDFQRRSGQLPVQKEGEEVDYRGALHRDGSVLMSVSLDQLKMPEVLYKSLAAKLIVGMPFKDLATVDSILLRELPPVDDADARLALKRLIDISMGVITPLTEQLTKPLPNAMVLVNLKEISTGAYKLLPQGTRLVVSVRGDEPYEELDILKGVDATMLLHDLPYTEDRISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEEX

SEQ ID NO: 10352 - protein, 264 aa, Glycine max
QYMKASLAAAAEDIGKKEWGGGGPHDSGQYNQFPEDTGFFKREGTWNTEYGQFFLEWYSGKLLEHGERILVSAKGIFETTGVKLSGKVAGIHWHYRARSHAAELTAGYYNTRNNDGYLPIARMLAKHGVVFNFTCMEMKDREQPDFANCSPEGLVHQVKMATTTARAELAGENALERYDADAYAQVLSTSKSESGSGLAAFTYLRMNKRLFEADNWRHLVDFVRSMSEGGRRERLPAADSHGSDLYVGHIKATQEKHTQEAALV

SEQ ID NO: 10353 - protein, 517 aa, Glycine max
  misc_feature (517)..(517): Xaa can be any naturally occurring amino acid
  unsure (1)..(517): unsure at all Xaa locations
FSLLFIVCETHRREEMATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVRTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASVIKILTVKX

SEQ ID NO: 10354 - protein, 219 aa, Glycine max
  misc_feature (219)..(219): Xaa can be any naturally occurring amino acid
  unsure (1)..(219): unsure at all Xaa locations
NTEYGQFFLEWYSGKLLEHGERILVSAKGIFQTTGVKLSGKVAGIHWHYRARSHAAELTAGYYNTRHNDGYLPIARMLAKHGVVFNFTCMEMKDREQPDFAYCSPEGLVHQVKMATTTARAELAGENALERYDADAYAQVLSTSKSESGSGLAAFTYLRMNKRLFEGDNWRHLVDFVRNMSEGGRRERLPAADSHGSDLYVGHIKATREKHTQEAALVX

SEQ ID NO: 10355 - protein, 390 aa, Glycine max
  misc_feature (390)..(390): Xaa can be any naturally occurring amino acid
  unsure (1)..(390): unsure at all Xaa locations
MADSASASASSSRMWCSIPERFQLHAAMLALQFGYAGFHVVSRAALNMGISKLVFPVYRNIIAFLLLVPFAYFLEKKERPAITLNFLLQFFLLALVGITANQGFYLLGLDNTSPTFASAIQNSVPAITFLMAVILRIEQVRLNRKDGISKVAGTIFCVAGATVITLYKGPTIYSPTPPLHSERPAVVDFGTLSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASIALGEEFYLGGIIGAVLIVVGLYFVLWGKSEERKFAKEHAAITSTPEHSGIRSSSHAKTSLTQPLLPSSTENVX

SEQ ID NO: 10356 - protein, 362 aa, Glycine max
QNKVPLLSLEALHHLHIFIFVLAVVHVSFSLLTVVFGGARIRQWKHWEDSIAKQNYETGRVLKPKVTQVHQHDFIRGRFAGFDKDSAIVGWLLSFLKQFYGSVTKSDYVTLRHGFIMTHCRTNPKFNFHKYMIRALEDDFKQVVGISWYLWLFVVIFLLLNINGWHTYFWIAFIPVVLLLAVGTKLGHVITQLAQEVAEKHAAIEGDLVVQPSDEHFWFHRPHVVLFLIHFILFQNAFEIAFFFWIWVTYGFDSCIMGQVRYIVPRLVIGVFIQVLCSYSTLPLYAIVTQMGTHYKRAIFNEHLQQNIVGWAQKAKKRKGLKADGNPGQGSSQESANTGIQLGSIFKKASAPGGSSSATKAD

SEQ ID NO: 10357 - protein, 244 aa, Glycine max; identical to SEQ ID NO: 3842

SEQ ID NO: 10358 - protein, 388 aa, Glycine max
  misc_feature (388)..(388): Xaa can be any naturally occurring amino acid
  unsure (1)..(388): unsure at all Xaa locations
SSSGFGSFSATQTYMALESAPASADIRGVHTHGGGYVQYNIYGNLFEVSRKYVPPIRPVGRGAYGIVCAAVNAETHEEVAIKKVGNAFDNRIDAKRTLREIKLLRHMEHENVIALKDIIRPPQRYNFNDVYIVYELMDTDLHQIIQSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVRQLPQYPRQQFAARFPSMSPGAVDLLEKMLVFDPNRRITVEEALCHPYLAPLHDINEEPACVRPFSFDFEQPSFTEEDIKELIWRESVLFNPDPPIYX

SEQ ID NO: 10359 - protein, 301 aa, Glycine max
  misc_feature (301)..(301): Xaa can be any naturally occurring amino acid
  unsure (1)..(301): unsure at all Xaa locations
EPSRTIIDLYSMAPPLEHNGVSTSGDSLRSIPTPFLTKTFQLVDDHTIDHVISWNDSGSSFIVWNTTAFAKDLLPKYFKHNNFSSFVRQLNTYGFRKVVPDRWEFSNEYFRRDEKRLLCEIQRRKILPATPPTRATATAAVLSPLPLSTIPPAKLIVSPSNSAEEQVISSNSSPAELLDENDRLRKENILLTKELEEMRSLCNNIFNLMSNYANVQADGGSAGVAARCFGEDAVEEMNPKLFGVVIGTKRAREENDTVLSLHQPFHADVKSEALDFARRGENKKTPWLNQCHRANQRVCNX

SEQ ID NO: 10360 - protein, 433 aa, Glycine max
  misc_feature (433)..(433): Xaa can be any naturally occurring amino acid
  unsure (1)..(433): unsure at all Xaa locations
KEPQVDSPVPISSFSDEDEEIVQAVVSGSIPSYSLESRLGDTRRATAIRHEVVQRLTSRSLSGLPLEGFNYDSILGQCCEMPIGFVQIPVGVAGPLLLDGKEYTVPMATTEGCLVASTNRGCKAIHVSGGASSVLLRDGMTRAPVVRLPSAQRAAQLKFFLEDPLNFDSLAVVFNKSSRFARLQNIQCAIAGKNLYMRFRCSTGDAMGMNMVSKGVQNVLDFLQDDFPDMDVIGISGNFCSDKKAAAVNWIEGRGKSVVCEAIIKEDVVKKVLKTSVEALVELNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQX

SEQ ID NO: 10361 - protein, 662 aa, Glycine max
  misc_feature (662)..(662): Xaa can be any naturally occurring amino acid
  unsure (1)..(662): unsure at all Xaa locations
MEGENASKVIELVNEIASISEYRPPVKKQYCNLARRLKLLIPMFEEIRDMNKDALPEDTSNAVLAFKEALQSARELLRFGSEGSKLYLVLERDDIMNKFYEVTAQLEQSLGGISHDKLDISDEVKEQVELVLAQFRRAKGRVDEPDVRLYEDMLSVYNSSSDAATDPSVLSQLAEKLQLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQQTLTSTVLTPNYVLRSLIAQWCEANGIEPPKRPSDSQPSKSASAYSPAEQSKIESLLQKLTSVSPEDQRSAAGEIRLLAKRNADNRVAIAEAGAIPLLVGLLSVPDSRTQEHAVTALLNLSIYENNKGSIVSSGAVPGIVHVLKKGSMEARENAAATLFSLSVIDENKVTIGSLGAIPPLVTLLSEGNQRGKKDAATALFNLCIYQGNKGKAVRAGVIPTLMRLLTEPSGGMVDEALAILAILASHPEGKATIRASEAVPVLVEFIGNGSPRNKENAAAVLVHLCSGDQQYLAQAQELGVMGPLLELAQNGTDRGKRKAGQLLERMSRLVEQQQEVPIQTETQAQNEDTQPPLITNPDDSX

SEQ ID NO: 10362 - protein, 171 aa, Glycine max
  misc_feature (171)..(171): Xaa can be any naturally occurring amino acid
  unsure (1)..(171): unsure at all Xaa locations
VVLCDRQQRNTPKQTMDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACVRCLQQVKQEYCLVKNKLETMFRLEQQIVAAGGSIPTELSFSGX

SEQ ID NO: 10363 - protein, 280 aa, Glycine max
  misc_feature (280)..(280): Xaa can be any naturally occurring amino acid
  unsure (1)..(280): unsure at all Xaa locations
LSLGVAKVAENKSFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSARKWPKSNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSYX

SEQ ID NO: 10364 - protein, 126 aa, Glycine max
  misc_feature (126)..(126): Xaa can be any naturally occurring amino acid
  unsure (1)..(126): unsure at all Xaa locations
MFPDSDFLNKEIEIPIPGFHPYRLNLFRLVWRTIYVMLSTVISMLLPFFNDIGGLLGAFGFWPLTVYFPVEMYIIQKRIPKWSTKWICLQILSMTCLLMTIGAAAGSIAGIAIDLRTYKPFKTNYX

SEQ ID NO: 10365 - protein, 515 aa, Glycine max
  misc_feature (515)..(515): Xaa can be any naturally occurring amino acid
  unsure (1)..(515): unsure at all Xaa locations
RFIASQRPILSPLLLSFQRFPLWCSRVAGNNMVVDALNEDLRINGAVEPLPEDFDATAVIIDPVPLAVVDNGIVKEEAQIIKGKEKREIVLGRNIHTSCLEVTEPEADDEVTGDREAHMASVLARYKRALTERTKHHLGYPYNLDFDYGALTQLQHFSINNLGDPFIESNYGVHSRQFEVGVLDWFARLWELEKNEYWGYITNCGTEGNLHGILVGREVFPDGILYASRESHYSVFKAARMYRMECEKVDTLWSGEIDCDDFKAKLLSHQDKPAIINVNIGTTVKGAVDDLDLVIKKLEEAGFSHDRFYIHCDGALFGLMMPFVKRAPKVTFKKPVGSVSVSGHKFVGCPMPCGVQITRLEYVNALARDVEYLASRDATIMGSRNGHAPIFLWYTLNRKGYRGFQKEVQKCLRNAHYFKGRLVEAGIGAMLNELSSTVVFERPHDEEFIRKWQLACKGNIAHVVVMPNITIEKLDDFLNELLEKRATWFQDGKDQPYCISSDVGEKNCLCALHKX

SEQ ID NO: 10366 - protein, 482 aa, Glycine max
  misc_feature (482)..(482): Xaa can be any naturally occurring amino acid
  unsure (1)..(482): unsure at all Xaa locations
MAIEKHEDVESGYLHEPFIQPEDAAAACKENGSDKSVKNGSIGMVLLSTLVAVCGSFTFGTCVGYSAPTQAAIRADLNLSLAEFSMFGSLVTIGAMLGAITSGRITDFIGRKGAMRISTGFCITGWIAVFFSKGSYSLDFGRFFTGYGIGVISYVVPVYIAEIAPKNLRGGLATTNQLLIVTGGSVSFLLGSVINWRELALAGLVPCICLLVGLCFIPESPRWLAKVGREKEFQLALSRLRGKDADISDEAAEILDYIETLQSLPKTKLLDLFQSKYVHSVVIGVGLMACQQSVGINGIGFYTAEIFVAAGLSSGKAGTIAYACIQIPFTLLGAILMDKSGRRPLVMVSAAGTFLGCFVAAFAFFLKDQSLLPEWVPILAFAGVLIYIAAFSIGLGSVPWVIMSEIFPIHLKGTAGSLVVLVAWLGAWVVSYTFNFLMSWSSPGTLFLYAGCSLLTILFVAKLVPETKGKTLEEIQACISSX

SEQ ID NO: 10367 - protein, 471 aa, Glycine max
  misc_feature (471)..(471): Xaa can be any naturally occurring amino acid
  unsure (1)..(471): unsure at all Xaa locations
MGSMHIETPETFADGSKNFDDDGRAKRTGTWITASAHIITAVIGSGVLSLAWAIAQMGWVAGPAVLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQX

SEQ ID NO: 10368 - protein, 436 aa, Glycine max
  misc_feature (436)..(436): Xaa can be any naturally occurring amino acid
  unsure (1)..(436): unsure at all Xaa locations
MLSIKRVPTVVSNYQKEETGEAAAGGCGRNCLKSCCIQGARLPLYAFKKVDKVCGNELPLLGCKEQHPVAFLDSLVLGEWEDRMQRGLFRYDVTACETKVIPGEYGFIAQLNEGRHLKKRPTEFRVDKVLQPFDENKFNFTKVGQEEVLFQLEASNDGEAQFFPNAPIDVENSPSFVAINVSPIEYGHVLLIPRIFKCLPQRIDHASFLLALQMAVEARNPYFRLGYNSLGAFATINHLHFQAYYLALPFPIEKAPTKKIAKLSGGVIISKLLNYPVRGLVFEGGHTLEDLANAVSEACICLQHNNIPYNVLISDCGRQIFLLPQCYAEKQALGEVSPELLETQVNPAVWEISGHMVLKRKKDYEEASEANAWRLLAEVSLSEERLLEVTALVFQAITSSVEMNVKPQRLEEVDAVSPNAQHAMVAGSHECLVLQX

SEQ ID NO: 10369 - protein, 477 aa, Glycine max
  misc_feature (477)..(477): Xaa can be any naturally occurring amino acid
  unsure (1)..(477): unsure at all Xaa locations
MENYQYPASYPDSGESSPRSREIDFENPPPWDEQQNQNYKAKFMCSYGGKIQPRTHDNQLSYVGGDTKILAVDRSVKFSAFLSKLSALCDSPPQDLTFKYQLPGEDLDALISVTNDDDLEHMMHEYDRLYRPNLKPVRMRLFLFTLSNSNPNSSFSSERDRFVEALNSGPVPSQPDPIKTPPVTPSNVDYLFGLDKAVAPPNLPPNFAAVKFHDPVPEPVAPTPVEYQSRVSDRVVGSDPNVNSMEIQRQMQQEMQRLQIAENEYRRRSEDGFATGYAAAAGGDYYMQKVQEKVPPQNAAVPPPAAYWSEKQFSGEGYQTTVTTAAPGGGDQPMYVMAAPGTFYHHSPVMRPPAAAQGYYAVQRMGSDGYREQQAVYGGMAAPKAGFSTAGMVKGPAYSEGYSGGVVRPAGLPDNAAYAQVAYDSASGRQVYYTAQGGVVHAPPQYQGGPPQDVRPGGVSVGQDGKVVNKVNQGSVX

SEQ ID NO: 10370 - protein, 487 aa, Glycine max
  misc_feature (487)..(487): Xaa can be any naturally occurring amino acid
  unsure (1)..(487): unsure at all Xaa locations
MVEKSSRTNLGHHQDFGMEAYSIDGVSSQSESKFYDDDGHVKRTGNVWTTSSHIITAVVGSGVLSLAWAMAQMGWVAGPVVMIFFSAVTLYTTSLLADCYRCGDPVTGKRNYTFMDAVQSILGGYYDTFCGVVQYSNLYGTAVGYTIAASISMMAIKRSNCFHSSGVKNPCHVSSNPYMIGFGIIQILFSQIPDFHKTWWLSIVAAIMSFAYSTIGLALGIAKVAETGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAQPLFAFVEKWASKRWPEVDTEYKVPIPGFSPYNLSPFRLVWRTVFVIITTIVAMLIPFFNDVLGLLGALGFWPLSVFLPVQMSIKQKRTPRWSSRWIGMQILSVVCLIVSVAAAVGSVASIVLDLQKYKPFHVDYX

SEQ ID NO: 10371 - protein, 694 aa, Glycine max
  misc_feature (694)..(694): Xaa can be any naturally occurring amino acid
  unsure (1)..(694): unsure at all Xaa locations
RNSNPGQDIAELQPASPGSPLLVPRQKYCESLHKTVRRKTNTVMVGNVAIGSEHPIRIQTMTTTDTKDVAGTVEQVMRIADKGADIVRITVQGKKEADACFEIKNTLVQKNYNIPLVADIHFAPSVALRVAECFDKIRVNPGNFADRRAQFETLEYTEEDYQKELEHIEKVFTPLVEKCKKYGRAMRIGTNHGSLSDRIMSYYGDSPRGMVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMIASELQKGVEPFEEKHRHYFDFQRRSGQLPVQKEGEEVDYRGVLHRDGSVLMSVSLDQLKMPEVLYKSLAAKLIVGMPFKDLATVDSILLREVPPVDDADARLALKRLIDISMGVITPLSEQLTKPLPNAMVLVNLKEISSRAYKLLPQGTRLVVSVRGDEPYEELDILKGIDATMLLHDLPYTEDKISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEEX

SEQ ID NO: 10372 - protein, 216 aa, Glycine max
  misc_feature (216)..(216): Xaa can be any naturally occurring amino acid
  unsure (1)..(216): unsure at all Xaa locations
NRQEDSLSRARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQEX

SEQ ID NO: 10373 - protein, 201 aa, Glycine max
  misc_feature (201)..(201): Xaa can be any naturally occurring amino acid
  unsure (1)..(201): unsure at all Xaa locations
KQFASTKLARSCISCFVDAASCKFLNNPFMIGFGILQLFLSQIPNFHELTWLSTAACITSFGYVFIGSGLCLLVVLSGKGAATSITGTKLPAEDKLLRVFTGLGNIALACTYATVIYDIMDTLKSHPSENKQMKRANVLGVTAMAILFLLCSGLGYAAFGDNTPGNILTGFTEPFWLVALGNGFIVIHMIGAYQVRSFFHX

SEQ ID NO: 10374 - protein, 342 aa, Glycine max
  misc_feature (342)..(342): Xaa can be any naturally occurring amino acid
  unsure (1)..(342): unsure at all Xaa locations
MELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYFYISGFFLTVSPDSIQLVAEHAAANNKFFMMNLSAPFICEFFKDALNKVLPYMDYVFGNETEARTFSKAQGWETDNVEEIALKISQLPKASETHKRITVITQGADPVCVAEDGKVKIYPVIPLPKEKLVDTNGAGDAFVGGFLSQLVKHKPIEECIRAGCYAANVIIQRPGCTYPPTPDFHX

SEQ ID NO: 10375 - protein, 180 aa, Glycine max
  misc_feature (180)..(180): Xaa can be any naturally occurring amino acid
  unsure (1)..(180): unsure at all Xaa locations
MKGYEPRSSSSCAACKLLKRRCIPNCIFAPYFRSDECKKFAKVHKVFGASNVSKILIEVPEEQREDTVNSLAYEAEARLRDPVYGCIGAIALLQRKMVELQHDLAIAKDRLARCHAAAAAATTTIPSPDILHANVSLPPFPDFCTSSSDFNDIFCHSSSSQLLGRHETVDDFNQIPYIFX

SEQ ID NO: 10376 - protein, 787 aa, Glycine max
  misc_feature (787)..(787): Xaa can be any naturally occurring amino acid
  unsure (1)..(787): unsure at all Xaa locations
LPSFLFFSSLHFHSLSLSAIIMGAVILPDLGTEILIPVCAIIGIGFALFQWVLVSKVKLSAARDASPNAAGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKIX

SEQ ID NO: 10377 - protein, 475 aa, Glycine max
  misc_feature (475)..(475): Xaa can be any naturally occurring amino acid
  unsure (1)..(475): unsure at all Xaa locations
AHSIGSDIGLKMGVAAESESNDNIPLLLTQSAYPLKRTGTVWTAVAHIVTGVIGSGVLSLPWSTAQLGWLAGPFSILLIASTTLFSSFLLCNTYRHPHPEYGPNRSASYLDVVHLHLGISNGRLSGLLVSISLYGFAIAFVITTAISLRTIQNSFCYHNKGPEAACESVDAYYMLLFGAIQIVLSQIPNFHNIKWLSVVAAIMSFTYSFIGMGLSIAQIIEKGHAEGSIGGISTSNGAEKLWLVSQALGDISFSYPFSTILMEIQDTLKSPPPENQTMKKASVIAVSVTTFLYLSCGGAGYAAFGDNTPGNLLTGFVSSKSYWLVNFANACIVVHLVGSYQVYSQPLFGTVENWFRFRFPDSEFVNHTYILKLPLLPAFELNFLSLSFRTAYVASTTVIAMIFPYFNQILGVLGSIIFWPLTIYFPVEIYLSQSSTVSWTTKWVLLRTFSFFGFLFGLFTLIGCIKGIVTEKISX

SEQ ID NO: 10378 - protein, 340 aa, Glycine max
  misc_feature (340)..(340): Xaa can be any naturally occurring amino acid
  unsure (1)..(340): unsure at all Xaa locations
MGRSPCCDENGLKKGPWTPEEDQKLVQHIQKHGHGSWRALPKLAGLNRCGKSCRLRWTNYLRPDIKRGKFSQEEEQTILHLHSILGNKWSAIATHLPGRTDNEIKNFWNTHLKKKLIQMGFDPMTHQPRTDLVSTLPYLLALANMTDLMDHQTLDEHAIRLQAEAVHLAKLQYLHYLIRSSNSLSTNKSYDQSATTNMEPAAFSLLNSISNVKENPVMLQPADDTPAASLSHGIVSSQPLHHPNVLPHHLLEPQVSFSSQSCLNSEIGQGTNFAIISQGDHTLDLDSSWIIPSITPPNAIGTSANNPGDASSSTSSYGGGPSSYWSELLFEDPILHELSX

SEQ ID NO: 10379 - protein, 471 aa, Glycine max; identical to SEQ ID NO: 10367
  misc_feature (471)..(471): Xaa can be any naturally occurring amino acid
  unsure (1)..(471): unsure at all Xaa locations

SEQ ID NO: 10380 - protein, 502 aa, Glycine max
  misc_feature (502)..(502): Xaa can be any naturally occurring amino acid
  unsure (1)..(502): unsure at all Xaa locations
MATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVRTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASVIKILTVKX

SEQ ID NO: 10381 - protein, 224 aa, Glycine max
MVVVMEQDTIKSPPAESETMSKATLISVLVTTVFYMLCGCFGYASFGDASPGNLLTGFGFYNPFWLIDIANAGIVIHLVGAYQVYCQPLFSFVESNAAERFPNSDFMSREFEVPIPGCKPYKLNLFRLVWRTLFVILSTVIAMLLPFFNDIVGLIGAIGFWPLTVYLPVEMYITQTKIPKWGIKWIGLQMLSVACFVITILAAAGSIAGVIDDLKVYKPFVTSY

SEQ ID NO: 10382 - protein, 412 aa, Glycine max
  misc_feature (412)..(412): Xaa can be any naturally occurring amino acid
  unsure (1)..(412): unsure at all Xaa locations
MMLRRRGSVTSFYSKFIDSHNLNCGRSSSNPHRVAASATSFDISSASASKATTDFVSLTRHYGRCYWELSKARLSMLVVATSGTGFVLGSGSAVDLSALSCTCLGTMMVAASANSLNQVFEINNDAKMKRTSRRPLPSGRITIPHAVGWASSVGLAGTALLATQTNMLAAGLAASNLILYAFVYTPLKQIHPINTWVGAVVGAIPPLLGWAAASNDISLNGMILPAALYFWQIPHFMALAYLCRDDYAAGGFKMYSLADASGHRTALVALRNSIYLIPLGFLAYDWGLTSGWFCLESAALTLAISAAAFSFYRNRTKEKARRMFHASLLYLPVFMSGLLIHRRSENEQFLEDKAKGFVKSASSTESSELDDDNGDQNIKARRPYRTEARPPVSYASVAPFPFLPAPSYNFPX

SEQ ID NO: 10383 - protein, 497 aa, Glycine max
  misc_feature (497)..(497): Xaa can be any naturally occurring amino acid
  unsure (1)..(497): unsure at all Xaa locations
MATSDSNMLLNYVPVYVMLPLGVVNVDNVFEDPDGLKEQLLQLRAAGVDGVMVDVWWGIIELKGPKQYDWRAYRSLFQLVQECGLTLQAIMSFHQCGGNVGDIVNIPIPQWVLDIGESNHDIFYTNRSGTRNKEYLTVGVDNEPIFHGRTAIEIYSDYMKSFRENMSDFLESGLIIDIEVGLGPAGELRYPSYPQSQGWEFPGIGEFQCYDKYLKADFKAAVARAGHPEWELPDDAGKYNDVPESTGFFKSNGTYVTEKGKFFLTWYSNKLLNHGDQILDEANKAFLGCKVKLAIKVSGIHWWYKVENHAAELTAGYYNLNDRDGYRPIARMLSRHHAILNFTCLEMRDSEQPSDAKSGPQELVQQVLSGGWREDIRVAGENALPRYDATAYNQIILNARPQGVNNNGPPKLSMFGVTYLRLSDDLLQKSNFNIFKKFVLKMHADQDYCANPQKYNHAITPLKPSAPKIPIEVLLEATKPTLPFPWLPETDMKVDGX

SEQ ID NO: 10384 - protein, 155 aa, Glycine max
  misc_feature (155)..(155): Xaa can be any naturally occurring amino acid
  unsure (1)..(155): unsure at all Xaa locations
DTINPIIKGISLQPCNTTLQPKVCTTRMSQGRGSASLPIVVTVVSLLCLLVLLERADAATYTVGGPGGWTFNTNAWPKGKRFRAGDILIFNYDSTTHNVVAVDRSGYNSCKTPGGAKVFSSGKDQIKLARGQNYFICNYPGHCESGMKVAINAVX

SEQ ID NO: 10385 - protein, 370 aa, Zea mays
  misc_feature (370)..(370): Xaa can be any naturally occurring amino acid
  unsure (1)..(370): unsure at all Xaa locations
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMGEADLAFIDNPKARKYIKSLPYAPGAPFTGMYPQAHPLAIDLLQKMLVFDPSKRISVTEALEHPYMSPLYDPSANPPAQVPIDLDIDENLGVDMIREMMWQEMIHYHPEVLTRISMX

SEQ ID NO: 10386 - protein, 148 aa, Zea mays
  misc_feature (148)..(148): Xaa can be any naturally occurring amino acid
  unsure (1)..(148): unsure at all Xaa locations
HHLLAGRKSIRGAEAHPRGAEEKKAMQTRGDSKMPRATSDAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLGX

SEQ ID NO: 10387 - protein, 268 aa, Zea mays
  misc_feature (268)..(268): Xaa can be any naturally occurring amino acid
  unsure (1)..(268): unsure at all Xaa locations
KFHFICQSTIGCPFGEGCHFLHFVPGGYPAVAKMLNLSSSAVSVPSRTHVDHAALTGASHPASTVKTRMCTKYNTTEGCKFGDKCHFAHSERELAKPAYMSQEGPPMGGRYGRAEPMQPAAMGPPAGNFGASATAKISVDASLAGGIIGKGGVNTKQISRITGVKLSIRDHESNPNLKNIELEGNFDQIKQASDLVRDLIATISASMPAKNPSAAAAPAGGGRGGGPGGKSSNYKTKLCENFLKGACTFGDRCHFAHGETEQRRGAAX

SEQ ID NO: 10388 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10389 - protein, 304 aa, Zea mays
  misc_feature (304)..(304): Xaa can be any naturally occurring amino acid
  unsure (1)..(304): unsure at all Xaa locations
MNTSPSRYRAMMGGWGGSDGYEGSKRTRMMMESNPYFAVNAGSPLDVSKRARMMEPGAPYFGAMGSSASGAGGGFYQPFNSNLAGAGSSTGIQSFPCVRLRGLPFDCNDIDVCKFFVGLDIVDCLLVNKNGRFTGEAFVVFPTSMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRHX

SEQ ID NO: 10390 - protein, 244 aa, Zea mays
TLGDSKERLCGAIQLSNLFGIGIGVSIAASVSMQAIRRAGCFHYRGHEDPCHASTSPYIAVFGVMQIVFSQIPDLDKVWWLSTVAAIMSFSYSTIGILLGVVQIVEHGGPRGSLAGVIGAGARVTMMQKVWRSLQAFGNIAFAYGFSIILLEIQDTIKSPPPSEAKVMKKATAVSVAVTTVIYLLCGCVGYAAFGGAAPDNLLTGFGFYEPFWLLDVANAFVVVHLVGTYQVMSQPVFAYVERR

SEQ ID NO: 10391 - protein, 380 aa, Glycine max
  misc_feature (380)..(380): Xaa can be any naturally occurring amino acid
  unsure (1)..(380): unsure at all Xaa locations
MSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEEX

SEQ ID NO: 10392 - protein, 462 aa, Glycine max
  misc_feature (462)..(462): Xaa can be any naturally occurring amino acid
  unsure (1)..(462): unsure at all Xaa locations
MGEEEIDDSPLIQGFPSGDVPFRRTGNVERAVAHIITGVIGAGVLSLAWSVAQLGWIAGPFIIIVFAGTTFLSANLLSDCYRFPHPLYGNIRCPSYIDAVKVYLGDSRQKVCGVLVHASLYGATTAYVITSATSIRAILKSNCYHKEGHQAPCKYGDAVYMMLFGLVQIIMSFIPDLHNMAWVSIVAAIMSFTYSSIGLGLGITTVIENGRIMGSLTGVPASNIADKLWLVFQGIGDIAFAYPYTVILLEIQDTLESPPPENKTMKKASMIAILITTFFYLCCGCFGYAAFGNQTPGNLLTGFGFYEPYWLIDFANACIVLHLVGGYQIYSQPIYGAVDRWCSKRYPNSGFVNNFYQLKLPRLPAFQLNMFRICFRTAYVVSTTGLAILFPYFNQVIGVLGALGFWPLAIYFPVEMYFVQRKVEAWSRKWIVLRTFSFICFLVSLLGLIGSLEGIISEKLSX

SEQ ID NO: 10393 - protein, 389 aa, Glycine max
  misc_feature (389)..(389): Xaa can be any naturally occurring amino acid
  unsure (1)..(389): unsure at all Xaa locations
NSSWNIEEAMSTAGQVIKCRAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEEX

SEQ ID NO: 10394 - protein, 184 aa, Glycine max
MDAFNSFFDSRNRWNYDTLKNFRQISPVVQNHLKQVYFTLCFAVVAAAVGAYLHVLLNIGGFLTTVACMGSSFWLLSTPPFEERKRVTLLMAASLFQGSSIGPLIDLAIHIDPSLIFSAFVGTALAFACFSGAALVARRREYLYLGGLVSSGLSILLWLHFASSIFGGSTALFKFELYFGLLVF

SEQ ID NO: 10395 - protein, 462 aa, Glycine max
  misc_feature (462)..(462): Xaa can be any naturally occurring amino acid
  unsure (1)..(462): unsure at all Xaa locations
MDGKKSLQITRSGTGAYDDDGHAKRTGNLQSAVAHIITAVIGSGVLSLAWSTSQLGWIGGPVALLCCAIVTYISSFLLSDCYRTPDPVTGKRNYSYMDAVRVYLGYKRTCVAGFLQFLTLYGTSIAYVLTTATSLSAILRSNCYHKKGHEAPCKYGGNLYMALFGLVQIVMSFIPDLHNMAWVSVVAALMSFTYSFIGLGLGIATVIKNGRIMGSLTGIPTDKIADKFWLVFQALGDIAFAYPYSILLLEIQDTLESPPPENQTMKKASMVAIFITTFFYLCCGCFGYAAFGNDTPGNLLTGFGFFEPFWLIDLANACIILHLVGGYQIYSQPIYSTVDRWASRKFPNSGFVNNFYKVKLPLLPGFQLNLFRFCFRTTYVISTTGLAIFFPYFNQILGVLGAINFWPLAIYFPVEMYFVQNKIAAWSSKWIVLRTFSFACFLVTGMGLVGSLEGIVSAKLKX

SEQ ID NO: 10396 - protein, 462 aa, Glycine max
  misc_feature (462)..(462): Xaa can be any naturally occurring amino acid
  unsure (1)..(462): unsure at all Xaa locations
MDGKNSLQITRSGIGAYDDDGHAKRTGNLQSAVAHIITAVIGSGVLSLAWSTSQLGWIGGPFSLLCCAIVTYISSFLLSDCYRTPDPVTGKRNYSYMDAVRVYLGYKRTCVAGFLQFLTLYGTSIAYVLTTATSLSAILRSNCYHKKGHEAPCKYGGNLYMALFGLVQIVMSFIPDLHNMAWVSVVAALMSFTYSFIGLGLGIATVIKNGRIMGSLTGIPTDKIADKFWLVFQALGDIAFAYPYSILLLEIQDTLESPPPENQTMKKASMVAIFITTFFYLCCGCFGYAAFGNDTPGNLLTGFGFFEPFWLIDLANACIILHLVGGYQIYSQPIYSTVDRWASRKFPNSGFVNNFYRVKLPLLPGFQLNLFRFCFRTTYVISTIGLAIFFPYFNQILGVLGAINFWPLAIYFPVEMYFVQQKIAAWSSKWIVLRTFSFACFLVTVMGLVGSLEGIVSAKLKX

SEQ ID NO: 10397 - protein, 122 aa, Glycine max
  misc_feature (122)..(122): Xaa can be any naturally occurring amino acid
  unsure (1)..(122): unsure at all Xaa locations
SNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSYX

SEQ ID NO: 10398 - protein, 290 aa, Glycine max
  misc_feature (290)..(290): Xaa can be any naturally occurring amino acid
  unsure (1)..(290): unsure at all Xaa locations
IMSFTYSSVGLSLGVAKVAENKTFKGSLMGISIGTVTQAGTVTSTQKIWRSLQALGAMAFAYSFSIILIEIQDTIKFPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSYX

SEQ ID NO: 10399 - protein, 246 aa, Triticum aestivum
  misc_feature (246)..(246): Xaa can be any naturally occurring amino acid
  unsure (1)..(246): unsure at all Xaa locations
GEQRASRSRGQSKPFPILARSRKRKGPCSAARLRVWEEALPAGGGETGEMGRGRSEIKRIDNPTQRQSTFYKRRDGLFKKARELAVLCDADLLLLLFSASGKLYQYLAPTVPSVKEFVERYEASRHTKVWSDIRQERRRELEKVAKMCDLLEKELRFMTVDDGERYTVPSLAALEHNLEAAMHKVRSEKDRKIGGEMSYLENMIRGKQAERYGLCDKLAHAQSLKVVEGGSTSLNNGLDLKLGFNX

SEQ ID NO: 10400 - protein, 242 aa, Zea mays
  misc_feature (242)..(242): Xaa can be any naturally occurring amino acid
  unsure (1)..(242): unsure at all Xaa locations
HWVGRAQKKEAAALIGWSFLLTDRRVKPLWSVTMSRRAAALLLACLVAVTAAALADGALLPWFGDGRRGLDEAAVTDVGLLAADPFRILEHVPFGFDRDDVAMVSMARVDWRETPDAHEIVVDVPGMRREDLRIEVEDNRVLRVSGERRRAEERKGDHWHREERSYGRFWRRFRLPENADLDSVAASLDSGVLTVRFRKLAPEQIKGPRVVGIAGGDGGAEAKESIGTGAGDGHQTKKVELX

SEQ ID NO: 10401 - protein, 470 aa, Zea mays
  misc_feature (470)..(470): Xaa can be any naturally occurring amino acid
  unsure (1)..(470): unsure at all Xaa locations
ERLNRKSSMTSSIPKLLLLLFFLSHRSPIARAGDDGSYKVLSMGSPRTDSVCSQSKAVPSSSAGAATVPLHHRHGPCSPLPTKKMLTLEETLHRDQLRAAYIQRKFSGGGGAGGDVQRSDATVPTALGTSLNTLEYLITVGLGSPATSQTMLIDTGSDVSWVQCKPCSQCHSQADPLFDPSSSSTYSPFSCGSAACAQLGQEGNGCSSSSQCQYIVTYGDGSSTTGTYSSDTLALGSSAVKSFQFGCSNVESGFNDQTDGLMGLGGGAQSLVSQTAGTLGRAFSYCLPPTPSSSGFLTLGAAGGSGTSGFVKTPMLRSSQVPTFYGVRLQAIRVGGRQLSIPASVFSAGTVMDSGTVITRLPPTAYSALSSAFKAGMKQYPPAQPSGILDTCFDFSGQSSVSIPSVALVFSGGAVVSLDASGIILSNCLAFAANSDDSSLGIIGNVQQRTFEVLYDVGRGVVGFRAGACX

SEQ ID NO: 10402 - protein, 362 aa, Zea mays
  misc_feature (362)..(362): Xaa can be any naturally occurring amino acid
  unsure (1)..(362): unsure at all Xaa locations
TKEERTDRLLHRSDMAFAPKTSSSSSLSSALQAAQSPPLLLRRMSSTATPRRRYDAAVVVTTTTTARAAAAAVTVPAAPPQAPAPAPVPPKQAAAPAERRSRPVSDTMAALMAKGKTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALPX

SEQ ID NO: 10403 - protein, 1044 aa, Zea mays
  misc_feature (1044)..(1044): Xaa can be any naturally occurring amino acid
  unsure (1)..(1044): unsure at all Xaa locations
MFTPQGKGWTGWSTPTPANQRSGGGAPAASAPLGKGKGRVAELEQELHEYQYNMGLLLIEKKEWAAKFEEISEVLTQKEEILKREQAAHLNAISEYERREENMRKALGVEKQCVADLEKALRDIRAEIAEVKFTSEKKITDAQSLEASLEEKSLEIEGKLHAADAKLAEANRKKSQADRDLEEAEARQRRLEKEKLYFETERKAREKQLKEQEESLQEWEKKLKESQNRLNELQRSINEREERANKNDQLFKIKQDELEEARRTVEAAKVTLKVKEDDINKRLNELHLQEKDADSKRSALEEQGKKLDEREAKVTNREKEGLQKLLEDHQVELESKRRDFELELERERKSFDQNMTQKQADLLKREKDVKSLEAKLSKSEQALNDKKKSMENLQNDLDAKSKALKSWDESLKNDEKRLLKEKQQMDHEREQLETYKLELEKIKSALEAEKEKISEEQNNLKLTAQERQEHSLLIAKLKKEIEEYRMRSNSLSEEMEDLRKQRQKFEEEWEQLDEKRALLVEEDKRLNIERMNLERWRDNEEKRLNDMKLKMDEEYKQQLESLERKEKALSDDMKHKQMENDEFLKGERADVQRKLQLKRHELEMEMEQKQATKEKELEEKENELNKKIDFVENKLRHAIELNESKIEKLLLEKREVQMERELLLEERKKTETDKADIRRDIESLHSLSKSLKERREAYNRDRSRLIELFEKYKACKNCGISIFEGLDSLLLKDSAEIEHPSLAVEGDDHALTTDTSGPDTGTLVNSGGRFSLLQKCSRLFKFSPRKKGEQSSEQPSERNISFGARLEEATQSDGDYVPTPVYEIAHDSFNAEDELPSDGETRENEESERHDIADNAQMESSVGVADNSIDILGTKSFDGANDMAVEATIVSVDQNGEDSVVPAEAGVEPETSEQGRRQQNQRGRRKGGMKRTRSVNAVVEDAKMILGEVFEEKTDDQGDTVKVGATRKRRFAGATISEQDEEGSEAHSESVSLGGQRRKRRQTAGAVTDAPGERRYNLRHSRAANAGAATAQADKKKIFKSKKX

SEQ ID NO: 10404 - protein, 360 aa, Zea mays
EVIPLLTPYKMGQFELSHRVVLAPLTRCRSYGNVPQPHAAVYYSQRATRGGLLIAEATGVSATAQGFPESPGIWTQEQVEAWKPIVDAVHRKGAIFVCQIWHVGRVSTNELQPNGDAPISSTDKQISPDAKSGTAYSKPRRLRTDEVPGIVDDFRRAARNAIQAGFDAVEIHGAHGYLLEQFMKDSCNDRTDQYGGSLENRCRLAVEVVDAVVREVGARRVGIRLSPFVDFVDCVDSDPVALGHYMVQQLNRHSGLLYCHMVEPRITAHGRRQIPHGLLPFRKAFHGTFIAAGGYDREEGNKVVAEGYADLVAYGKLFLANPDLPRRFELDVALNKYDRSTFYTQDPIVGYTDYPFFEEE

SEQ ID NO: 10405 - protein, 608 aa, Zea mays
  misc_feature (608)..(608): Xaa can be any naturally occurring amino acid
  unsure (1)..(608): unsure at all Xaa locations
GKQIGWRQPVAGSAGTMGGEAEGGERRLGRVLSFGIPDTALGLVMGYVEDPWDRDAISLVCRHWCRVDALSRKHVTVAMAYSTTPERLFGRFPCLESLKLKAKPRAAMFNLISDDWGGSASPWIRQLSATFHSLKKLHLRRMIVSNDDINTLVRAKAHMLVSLKLDRCSGFSTPSIALIARSCRKLETLFLEESMIDEKENDEWIRELATSNSVLETLNFFQTDLRASPEYLTLLVRNCQRLKTLKISECFMPDLVSLFRTAQTLQEFAGGSFEDQGQPVAGRNYENYYFPPLLHRLSLLYMGTNEMQILFPYAAALKKLDLQFTFLSTEDHCQIVQRCPNLETLEVRDVIGDRGLQVVAETCKKLQRLRVERGDDDQGGLEDEQGRISQVGVMAIAQGCPELTYWAIYVSDITNAALEAVGTCSRNLNDFRLVLLDREAHITELPLDNGVRALLRGCTKLRRFAFYVRPGVLSDVGLGYVGEFSKSIRYMLLGNVGESDNGIIQLSKGCPSLQKLELRGCLFSEHALAMAALELKSLRYLWVQGFRSSPTGTDLMAMVRPFWNIEYILPDQDEPCPEYKKQILAYYSLAGRRTDCPPSVTPLYPAVX

SEQ ID NO: 10406 - protein, 241 aa, Zea mays
  misc_feature (241)..(241): Xaa can be any naturally occurring amino acid
  unsure (1)..(241): unsure at all Xaa locations
MAAAPFAIAGRLSPVARLPVRAWRPAHGFASSGRARSLAVASAAQENRDNSVDVQVSQNGGNRQQGNAVQRRPRRATALDISPSPFGLVDPMSPMRTMRQMLDTMDRLFDDAVGFPMGTRRSPATTGDVRLPWDIVEDEKEVKMRIDMPGLARDEVKVMVEDDTLVIRGEHKKEEGAEGGSGGDGDGWWKQRSVSSYDMRLALPDECDKSKVRAELKNGVLLVTVPKTEVERKVIDVQVQX

SEQ ID NO: 10407 - protein, 206 aa, Zea mays
  misc_feature (206)..(206): Xaa can be any naturally occurring amino acid
  unsure (1)..(206): unsure at all Xaa locations
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGGGDCFKCGKPGHFARECPSGDGGRGDRYGGRDDRYGGGGGGGGGRYGSDRGGDRYSGRSRDGGSYGGGDRYSRDRSGPYX

SEQ ID NO: 10408 - protein, 250 aa, Zea mays
  misc_feature (250)..(250): Xaa can be any naturally occurring amino acid
  unsure (1)..(250): unsure at all Xaa locations
AQKKEAAALIGWSFLLTDRRVPVRSKFQVRTYALKPLGSVTMSRRAAALLLACLVAVTAAALADGALLPWFGGGRRGLDEAAVSDVGLLAADPFRILEHVPFGFDRDDVAMVSMARVDWRETPDAHEIVVDVPGMRREDLRIEVEDNRVLRVSGERRRAEERKGDHWHREERSYGRFWRRFRLPENADLDSVAASLDSGVLTVRFRKLAPEQIKGPRVVGIAGGDGGAEAKESIGTGAGDGHQTKKVELX

SEQ ID NO: 10409 - protein, 219 aa, Zea mays
  misc_feature (219)..(219): Xaa can be any naturally occurring amino acid
  unsure (1)..(219): unsure at all Xaa locations
MASIVASRRAVPLVRALEKLIAASSAPGTGSALRPVAVAGGLRGYNTGAPLRRYEGAESEDDSVREYDGRHGGRDYAVPSLFSDIFRDPLSAPHSIGRLLNLMDDLAVAAPGRAVRRGWNAKEDEEALHLRVDMPGLGKEHVKVWAEQNSLVIKGEGEKEDSEDEAAPPPRYSGRIELAPEVYRMDKIKAEMKNGVLKVVVPKVKEQQRKDVFQVNVEX

SEQ ID NO: 10410 - protein, 289 aa, Zea mays
  misc_feature (289)..(289): Xaa can be any naturally occurring amino acid
  unsure (1)..(289): unsure at all Xaa locations
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIVAQCLGAICGVGLVKGLQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNAX

SEQ ID NO: 10411 - protein, 311 aa, Zea mays
ATVSSFPVVNMEKLETEERATAMEVIRDGCENWGFFELLNHGISHELMDEVERLTKAHYATFREAKFQEFAARTLEAGEKGADVKDVDWESTFFVRHLPASNLADLPDVDDRYRQVMEQFASEIRKLSERLLDLLCENLGLEPGYLKAAFAGSDGPTFGTKVSAYPPCPRPDLVDGLRAHTDAGGIVLLFQDDQVSGLQLLRGGEWVDVPPMRHAIVANVGDQLEVITNGRYKSVMHRVLTRPDGNRMSVASFYNPGADAVIFPAPALVGAAEEDRAEAAYPSFVFEDYMNLYVRHKFEAKEPRFEAMKSA

SEQ ID NO: 10412 - protein, 554 aa, Zea mays
  misc_feature (554)..(554): Xaa can be any naturally occurring amino acid
  unsure (1)..(554): unsure at all Xaa locations
MDEDFEMPPAGADEMMGDDEMGDFGGDEGPVMKVGEEKEVGKEGLKKKLLKEGEGWETPEVGDEVEVHYTGTLLDGTKFDSSRDRGEPFKFKLGQGQVIKGWDQGIKTMKKGENAIFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGAVPPNASLLIDLELISWKTVTEIGDDKKILKKVLKEGEGYERPNEGAVVEVKIIGKLQDGAVFTKKGHDEEPFKFKTDEEEVIAGLDRAVLNMKKGEVALVTIPPEYAFGSTESKQDLAVVPPNSTVIYEVELISFVKDKESWDLNNEEKIEAAGKKKEEGNALFKSGKYARASKRYEKAAKYIEYDTSFSEDEKKQSKQLKISCNLNNAACKLKLKDYKEAAKLCTKVLELDSQNVKALYRRVQAYIQLADLELAEADIKKALEIDPDNRDVKLEYKILKEKIKEYNKKDAKFYSNMFAKMTKX

SEQ ID NO: 10413 - protein, 613 aa, Zea mays
  misc_feature (613)..(613): Xaa can be any naturally occurring amino acid
  unsure (1)..(613): unsure at all Xaa locations
LPGEKKTTAPPPPPPLRARRPPDEGPAASFTVSWMSNHNAPCDIPKPASVDEFLAKNGKKKKSFMSGLFRKKGRGADKKLLSRRDIVFDLEGRSGDRMDLLETSAAVRKSFSDRHCTTRIENLTLSCLDSPRRPNVDTREYRVFVGTWNVGGKPPDSSVNLQEFLQIEGLPDIYVLGFQEIVPLNAGNVLVVEDNEPAGKWMDLIYQALNRPPPHQDGQSSGDELSPPPSTSSSHYPSRPQGAARDPSNAAAIPKTSSGGMLCAQKPPPPLKMVSKCYRVDNALVKTCTCMSDPSTMQLRAREMREFLCRVEAAAASPGRGADDDALASIEGGDQRGGGGGMNYCLVARKQMVGIFLSVWVRRELVQYVGHLRVDCIGRGIMGRLGNKGCIAMSMTLHHTSICFVCCHLASGEKEGDEVRRNSDVAEILKNAQFPRICKVPGQRVPEKIIDHDRIIWLGDLNYRVSLSYEETKTLLEDNEWDILLEKDQLAMERQAGRVFKGWKEGKIYFAPTYKYKQNSDSYLWETAKSKKKRRTPAWCDRILWHGQGIEQLQYIRGEFRLSDHRPVCSVFVIEADVDSGSKIRKGYSTLDARIHCESPEIPKRHSFYDDFX

SEQ ID NO: 10414 - protein, 401 aa, Zea mays
  misc_feature (401)..(401): Xaa can be any naturally occurring amino acid
  unsure (1)..(401): unsure at all Xaa locations
ARRNPSPPRLADGDGRCMIGASPWNRLPSGIAKPAAAAAVVVAALASSFLALPRPRAAPPPAGSGPLMSKAKVYTDVNVLRPKEYWDYEALTVQWGEQDDYEVVRKVGRGKYSEVFEGINVNNYEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYHIELDPQLEALVGRHSRKPWSKFMNADNQHLVSPEAIDFLDKLLRYDHQDRLTAREAMAHPYFLQVRAVENSRTRPQX

SEQ ID NO: 10415 - protein, 240 aa, Zea mays
HDVEACYPPGAAGGGKYPYMTENPQLRWAFIRKVYVIVCLQLLLTVAVAATVNLVRAIGDFFLSRTMGAMFAIIGVIVAPILVMIPMIIYRKRHPVNLALLALFTVCISFAVGLSCLTANGPVILEAVVITMVVVLGLTFYTFWAAKRGYEFEFLGPFLVSACLILMLFSLLRIIFPLGRTGTMVYGCIAALVFSGFIIYDTDNLIRVYSYDEYVAAAIELYLDIINLFQAILAVLEGVD

SEQ ID NO: 10416 - protein, 389 aa, Zea mays; identical to SEQ ID NO: 10019
  misc_feature (389)..(389): Xaa can be any naturally occurring amino acid
  unsure (1)..(389): unsure at all Xaa locations

SEQ ID NO: 10417 - protein, 156 aa, Zea mays
  misc_feature (156)..(156): Xaa can be any naturally occurring amino acid
  unsure (1)..(156): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRNX

SEQ ID NO: 10418 - protein, 318 aa, Zea mays
PAPPRPLATAMASPYSLSWADAPPYHYHGRPQPAPDSPASSDGAGPRSLWIGGLLPWMDEDYLYGCFTTSRELLSLVIKRNKQTGQSEGFGFLKFSDHTAAAHILKSYNGQKMPNAVQDFKLNWATQQPAPKKLPDPDFKLDLATQQERHAAVDSSSDHSIFVGDLAYNVTGYMLHHVFKARYPSVKSAKIIFDKFTGLSKCYGFVQFGDVDEQIQALTEMNGAYCSTRPMRIGPVPKKKNSFRSKQWTESYHDANNSRLFVGQLDQSVTSEDLMQAFSPYGELVDVKALPGKGCGFVTYSNRASAEEAIRMLNGSQL

SEQ ID NO: 10419 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 10420 - protein, 591 aa, Arabidopsis thaliana
  misc_feature (591)..(591): Xaa can be any naturally occurring amino acid
  unsure (1)..(591): unsure at all Xaa locations
QKTKTMGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASSX

SEQ ID NO: 10421 - protein, 586 aa, Arabidopsis thaliana
  misc_feature (586)..(586): Xaa can be any naturally occurring amino acid
  unsure (1)..(586): unsure at all Xaa locations
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASSX

SEQ ID NO: 10422 - protein, 692 aa, Arabidopsis thaliana
  misc_feature (692)..(692): Xaa can be any naturally occurring amino acid
  unsure (1)..(692): unsure at all Xaa locations
NQGSDLAELQPASEGSPLLVPRQKYCESLHKTVRRKTRTVMVGNVALGSEHPIRIQTMTTSDTKDITGTVDEVMRIADKGADIVRITVQGKKEADACFEIKDKLVQLNYNIPLVADIHFAPTVALRVAECFDKIRVNPGNFADRRAQFETIDYTEDEYQKELQHIEQVFTPLVEKCKKYGRAMRIGTNHGSLSDRIMSYYGDSPRGMVESAFEFARICRKLDYHNFVFSMKASNPVIMVQAYRLLVAEMYVHGWDYPLHLGVTEAGEGEDGRMKSAIGIGTLLQDGLGDTIRVSLTEPPEEEIDPCRRLANLGTKAAKLQQGVAPFEEKHRHYFDFQRRTGDLPVQKEGEEVDYRNVLHRDGSVLMSISLDQLKAPELLYRSLATKLVVGMPFKDLATVDSILLRELPPVDDQVARLALKRLIDVSMGVIAPLSEQLTKPLPNAMVLVNLKELSGGAYKLLPEGTRLVVSLRGDEPYEELEILKNIDATMILHDVPFTEDKVSRVHAARRLFEFLSENSVNFPVIHHINFPTGIHRDELVIHAGTYAGGLLVDGLGDGVMLEAPDQDFDFLRNTSFNLLQGCRMRNTKTEYVSCPSCGRTLFDLQEISAEIREKTSHLPGVSIAIMGCIVNGPGEMADADFGYVGGSPGKIDLYVGKTVVKRGIAMTEATDALIGLIKEHGRWVDPPVADEX

SEQ ID NO: 10423 - protein, 509 aa, Arabidopsis thaliana
  misc_feature (509)..(509): Xaa can be any naturally occurring amino acid
  unsure (1)..(509): unsure at all Xaa locations
RIGTNHGSLSDRIMSYYGDSPRGMVESAFEFARICRKLDYHNFVFSMKASNPVIMVQAYRLLVAEMYVHGWDYPLHLGVTEAGEGEDGRMKSAIGIGTLLQDGLGDTIRVSLTEPPEEEIDPCRRLANLGTKAAKLQQGVAPFEEKHRHYFDFQRRTGDLPVQKEGEEVDYRNVLHRDGSVLMSISLDQLKAPELLYRSLATKLVVGMPFKDLATVDSILLRELPPVDDQVARLALKRLIDVSMGVIAPLSEQLTKPLPNAMVLVNLKELSGGAYKLLPEGTRLVVSLRGDEPYEELEILKNIDATMILHDVPFTEDKVSRVHAARRLFEFLSENSVNFPVIHHINFPTGIHRDELVIHAGTYAGGLLVDGLGDGVMLEAPDQDFDFLRNTSFNLLQGCRMRNTKTEYVSCPSCGRTLFDLQEISAEIREKTSHLPGVSIAIMGCIVNGPGEMADADFGYVGGSPGKIDLYVGKTVVKRGIAMTEATDALIGLIKEHGRWVDPPVADEX

SEQ ID NO: 10424 - protein, 327 aa, Glycine max
  misc_feature (327)..(327): Xaa can be any naturally occurring amino acid
  unsure (1)..(327): unsure at all Xaa locations
MDNTKPLIELELDDDGRIRRTGNVWTASIHIITVVVGAGVLSLAWVMAQLGWLAGIASIITFSAVSIFTYNLVADCYRYPDPVTGKRNYTYMQAVKAYLGGTMHVFCGLVQYTKLAGITVGYTITSSTSLVAIRKAICIHKTGDAASCKFLNNPFMIGFGILQLFLSQIPNFHELTWLSTAACITSFGYVFIGSGLCLLVVLSGKGAATSITGTKLPAEDKLLRVFTGLGNIALACTYATVIYDIMDTLKSHPSENKQMKRANVLGVTAMAILFLLCSGLGYAAFGDNTPGNILTGFTEPFWLVALGNGFIVIHMIGAYQVRSFFHX

SEQ ID NO: 10425 - protein, 609 aa, Glycine max
  misc_feature (609)..(609): Xaa can be any naturally occurring amino acid
  unsure (1)..(609): unsure at all Xaa locations
MDTKIGSLDAPKPNSNDVVSCNLTSSAAIQPCLPATVINGAGCSDSTLGGHLARRLVEIGVTDVFSVPGDFNLTLLDHLIAEPALHLVGCCNELNAGYAADGYARARGVGACVVTFTVGGLSVLNAIAGAYSENLPLICIVGGPNSNDYGTSRILHHTIGLPDFSQELRCFQTITCFQAVVNNLEDAHELIDTAISTALKESKPVYISISCNLPGIPHPTFSRDPVRFSLSPRLSNKMGLEAAVEAAAEFLNKAVKPVLVGGPKLRVATASDAFVELADACGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNTAYENYHRIFVPDGHPLKAAPREPLRVNVLFQHIQNMLSGETAVIAETGDSWFNCQKLKLPKACGYEFQMQYGSIGWSVGATLGYAQAVPEKRVIACIGDGSFQVTAQDVSTMLRCGQKTIIFLINNGGYTIEVEIHDGPYNVIKNWNYTGLIDAIHNGEGKCWTAKVFCEEELVEAIATATGPKKDSLCFIEVIVHKDDTSKELLEWGSRVSAANSRPPNPQX

SEQ ID NO: 10426 - protein, 221 aa, Zea mays
  misc_feature (221)..(221): Xaa can be any naturally occurring amino acid
  unsure (1)..(221): unsure at all Xaa locations
SRKQGNHIAMAAKMFALFALLALCATATSATHIPGHLSPLLMPLATMNPWMQYCMKQQGVANLLAWPTLMLQQLLALPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSISHIIQQQQLPFMFSPTAMAISPMFLQQPFVGAAFX

SEQ ID NO: 10427 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10428 - protein, 295 aa, Zea mays
  misc_feature (295)..(295): Xaa can be any naturally occurring amino acid
  unsure (1)..(295): unsure at all Xaa locations
VPTASKAFSAAPPQQQRRGRRRRDQEPMDPKMTEVTQMFARFKAAYTRNDLDACVTLLSQLKVHLTKFPSLPPSFEQTPKAVEELKLARDIYEHAVVLSVKLEDQDAFERDFCQLKPYYMDTCGIIPPSPEEYPILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWELKNGAVFFQKAKESQPYKEIPSLQLINQTLSYARELERIVX

SEQ ID NO: 10429 - protein, 183 aa, Zea mays
  misc_feature (183)..(183): Xaa can be any naturally occurring amino acid
  unsure (1)..(183): unsure at all Xaa locations
RLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10430 - protein, 149 aa, Zea mays; identical to SEQ ID NO: 5266

SEQ ID NO: 10431 - protein, 227 aa, Zea mays
VAFAYTYSMLLIEIQDTVKAPPSENVTMKRASFYGISVTTIFYVSLGCIGYAAFGNAAPGNVLTGFDEPFWLVDVANIAVVVHLVGAYQVYAQPIFACYEKWLGSRWPDSAFFHHEYAVRLPGCAVRFTMCKLVLRTAFVAATTVVSLMLPFFNAVLGLLGAIAFWPLTVYFPVTMYIAQAKVAPGSRKWVALQALNVGALLVSLLAAVGSVADMVQRLGHVTIFQT

SEQ ID NO: 10432 - protein, 715 aa, Zea mays
  misc_feature (715)..(715): Xaa can be any naturally occurring amino acid
  unsure (1)..(715): unsure at all Xaa locations
MLHPSWVGVSAHVSEYWSVIIATVVFAFVGAVTIYYTVNQLNKNISLSLIRAIKARAKRYKKSKDKVPAASHIWRKEVVSRSKGLKCCVCLKSVSPPQYSGGTIHQCDICGAAAHPSCSGNAHKDCKCVSMAGLGHVLHQWAVQWIDSADHSEEDSFCCHCDESCNGAFLAGSPVWYCMWCQRLVHVDCHSSLAKETGDICDLGPLKRLILSPLCVKELHWTGAGILSSITNGANELASSVRETIRIRSKRYKRGSASADSDSSGAIELPSDAEGDSQEVNSKAKVRDDHANCKLNEVHQSSESEKDKQLVPDNAATTNMSDVQRENSHVQNNQKYEIINVPSDSRPLLVFINKRSGAQSGDSLRQRLQILLNPVQVFELSKQQGPDVGLALFRKVTHFRVLVCGGDGTAGWVLDAIEKQKFETPPPVAILPAGTGNDLARVLCWGGGLGVIEKRGGLFSVLQDVEHAAVTVLDRWKITIKDNQGKLMRPPKFMNNYFGVGCDAKVALDIHNLREENPERFYSQFMNKVLYAREGAKNIMDNTFDCFPWDVKLEIDGSKIDIPQDSEGILVANIRSYMGGVDLWKNEDDVSDTYLPQSMHDKKLEVVSFTGMLHLGKLQVGLSRAKRLAQGHHIKVEVSTTMPIQVDGEPWSQEPGTIEVSHHSQAFMLKRVSEEPLGHAASVMADILENAESSGIISALQKRTLLQEIASRLLX

SEQ ID NO: 10433 - protein, 500 aa, Zea mays
  misc_feature (500)..(500): Xaa can be any naturally occurring amino acid
  unsure (1)..(500): unsure at all Xaa locations
ISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10434 - protein, 632 aa, Zea mays
  misc_feature (632)..(632): Xaa can be any naturally occurring amino acid
  unsure (1)..(632): unsure at all Xaa locations
ITAAGDSKNLHAHARPRSPASRPRAVADSLSDPDPMGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPAX

SEQ ID NO: 10435 - protein, 497 aa, Zea mays
  misc_feature (497)..(497): Xaa can be any naturally occurring amino acid
  unsure (1)..(497): unsure at all Xaa locations
LLSFPGTCHGRRMDKSGGEAAAAAAAADDVERRGGDYEQDEHERRGTVWTATAHIVTAVIGSGVLALAWSVAQLGWVAGPLALAGFACVTYYTSTLLAGAYRAPHPVTGHRNRTYMDAVRSYLSPREVFMCGVAQYVNLWGTMVGYTITATISMAAIRQADCLRRDGAGAGARCDAPGTVLMLAFSVVQVVLSQFPGLEHITWLSVVAAAMSFAYSFAGLGLSVGHWVSRGGGGLGGRVAGAAAASSTRKLWNVLLALGNIAFAYTFAEVLIEIQDTLKSPPPENRTMKKAAMYGIGATTIFYISVGCAGYAAFGSNAPGNILAAGGLGPLWLVDIANMCLILHLIGAYQVYAQPVFASVERWAASRWPEAKFMSSAYTVSVSIPLLQRGSVTVAPHKLVLRTAIVGATTAVALAIPFFNAVLGLLGAFSFWPLTVYFPISMHIAQGKIARGTKWWCLLQALSMVCLVISVAVGVGSVTDIVDSLKASSSPFKIVGX

SEQ ID NO: 10436 - protein, 315 aa, Zea mays
  misc_feature (315)..(315): Xaa can be any naturally occurring amino acid
  unsure (1)..(315): unsure at all Xaa locations
VPMLIFLGGCWPACLHWKPRPTLGRSRPKGPCHWLSPPGRRAAAGRLEAPFPTGGMRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLGX

SEQ ID NO: 10437 - protein, 244 aa, Zea mays
  misc_feature (244)..(244): Xaa can be any naturally occurring amino acid
  unsure (1)..(244): unsure at all Xaa locations
MASADLLRKEEEFYSSLFDSAKGDGVKSRSQVIERKIESLEDMATKVSNRRSRRWLNDRLLIELVPRLHVEEIKGLFAPPPWGEELPLSAFCRTSVSDWEAFRSIDMDAEARLMQHMKRSSEKQRTHVDEDELIALNAWRRIGRQTREAIKKKFLPDLLQIYEEQVRAFIEGTGDSDVLVLNVQDPFQRLLLHGVCEFYNVTSMTTSSVRDGKPWKSTTIKKRHVTGLPPRITLVSFLRMRKNX

SEQ ID NO: 10438 - protein, 220 aa, Zea mays
  misc_feature (220)..(220): Xaa can be any naturally occurring amino acid
  unsure (1)..(220): unsure at all Xaa locations
SRSRLQLAASSSVSVDQQEAGVRGMAATSRLALALLLAALVAAWQLPAAAVAANYTVGDEKGWNPDVDYTAWVKKHKPFYKGDWLIFEYQNGRSDVVQVDEVGYDNCDKANALSSYSKGHTYAFQLKDAKDYYFICSYGYCYNGMKLHVTAKSSSSSSSSSSGSDSSSSSSDDDSSSPSPPAKKSKAKTSAAPPPSLLAATPMAAAAAAAAALLLNRMLX

SEQ ID NO: 10439 - protein, 226 aa, Glycine max
  misc_feature (226)..(226): Xaa can be any naturally occurring amino acid
  unsure (1)..(226): unsure at all Xaa locations
GFFKREGTWNTEYGQFFLDWYSTKLVEHGEKILVSAKGIFNSCGVKLSAKVAGIHWHYKTRSHAAELTAGYYNTRFRDGYLPIAQMVAKHGVVLNFTCMEMRDREQHEHCSPEGLVHQVKMAARTAGAELAGENALERYDAGAFSQVLSTSNSGSGLAAFTYLRMNRRLFEGDNWRHFVEFVKCMSEGGKRQRLPQSDSCGTHLYVGHITGIQKQQEQAQEVALVX

SEQ ID NO: 10440 - protein, 382 aa, Glycine max
  misc_feature (382)..(382): Xaa can be any naturally occurring amino acid
  unsure (1)..(382): unsure at all Xaa locations
VCTIVALRAPVAQPPILRIPNHLIETTNTFTIVHQRYRTQISGSNRRAMSKARVYTDVNVLRPKEYWDYESLTVQWGDQDDYEVVRKVGRGKYSEVFEGINVNSNERCVIKILKPVKKKKIKREIKILQNLCGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQX

SEQ ID NO: 10441 - protein, 284 aa, Glycine max
  misc_feature (284)..(284): Xaa can be any naturally occurring amino acid
  unsure (1)..(284): unsure at all Xaa locations
ANPSLSFSFSLIQILQKKKNTMAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQNX

SEQ ID NO: 10442 - protein, 653 aa, Glycine max
  misc_feature (653)..(653): Xaa can be any naturally occurring amino acid
  unsure (1)..(653): unsure at all Xaa locations
EGFSTKSQPCTYDKSKLCKPALATALFSTVSFLLGAITSVLSGFLGMKIATYANARTTLEARKGVGKAFITAFRSGAVMGFLLAANGLLVLYITINLFKLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTAMLYPLLISSMGIIVCLITTLFATDFFEIKAVKEIEPALKKQLIISTVLMTVGIAIISWIALPTSFTIFNFGAQKEVKSWQLFLCVGVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAGILTVDVLTPKVFIGLIVGAMLPYWFSAMTMKSVGSAALKMVEEVRRQFNTIPGLMEGHAKPDYATCVKISTDASIKEMIPPGALVMLTPLIVGIFFGVETLSGVLAGALVSGVQIAISASNTGGAWDNAKKYIEAGASEHARTLGPKGSEPHKAAVIGDTIGDPLKDTSGPSLNILIKLMAVESLVFAPFFATHGGLLFKIFX

SEQ ID NO: 10443 - protein, 264 aa, Glycine max
MTVEKEDLGLSLSLSFPQNPPTHLHLNLVSSSPSSHNPQKPSWNDPFTSSAGSSFLRGIDVNRLPSVVDCEEEAGVSSPNSTVSSVSGKRSEREEANGEENDTDRACSRGIISDEEDAETSRKKLRLSKDQSIILEESFKEHNTLNPKQKLALAKQLGLRARQVEVWFQNRRARTKLKQTEVDCEFLKRCCENLTVENRRLQKEVQELRALKLSPQFYMHMTPPTTLTMCPSCERVAVPPSSAVDPAMRHHHVPPTQPRAFPIG

SEQ ID NO: 10444 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10445 - protein, 410 aa, Glycine max
  misc_feature (410)..(410): Xaa can be any naturally occurring amino acid
  unsure (1)..(410): unsure at all Xaa locations
MDPPPKSWSIHTRSEIIAKYEVMERVGSGAYADVYRGRRLSDGLTVALKEIHDYQSAFREIDALQLLEGSPNVVVLHEYFWREDEDAVLVLEFLRTDLATVIADTAKANQPLPAGELKCWMIQILSGLDACHRHMVLHRDLKPSNLLISEHGLLKIADFGQARILMEPGIDASNNHEEYSRVLDDIDNKDTITSTHDGNATCNTSDVDREEEELGCFTSCVGTRWFRAPELLYGSRNYGLEVDLWSLGCIFAELLTLQPLFPGTADIDQLSRIIGVLGNLDENAWAACSKLPDYGIISFSKVENPAGLEACLPNRSPDEVALVKKLVCYDPAKRATAMELLHDKYFSDEPLPVLVSELRVPLTRKEQDGDSPGGWGDINDMDSDSDSQFDEFGPLNITRTGTGFSIQFPX

SEQ ID NO: 10446 - protein, 378 aa, Glycine max
  misc_feature (378)..(378): Xaa can be any naturally occurring amino acid
  unsure (1)..(378): unsure at all Xaa locations
MVESIAATSLLGHRPICGGSLTRDVSAKRKSLNTVRFPTTEFLGGGRIVVSLALPKSDKQDRFVFSSIKALAVELTREAHAYREKKLPNRDNKIDRGFDQRPDLWPPANRADKLSLRNPLLRHERMGCGWLGAIFEWEGVLIEDNPDLEKQAWLALSQEEGKPSPPAFILKRIEGMKNEQAISEVLCWSRDPAQLRRMANRKEEIYQALLGGIYSFLSGSKEFVSVLMHYKIPMALVSTRPRKALESAMGEIGIEDTFSVIVAAEDVHRGKPDPEMFVYAAQLLNFIPERVIVFGNSNLTVEAAHEARMKCVAVASRHPVYELGAADLVVRRLDELSVVDLKNLADIEMTEFGSVEPEMELEVEKDHDTSSLDDNFWX

SEQ ID NO: 10447 - protein, 566 aa, Glycine max
  misc_feature (566)..(566): Xaa can be any naturally occurring amino acid
  unsure (1)..(566): unsure at all Xaa locations
LIMNLSLCNSSNLNTSRKPLMALPHSISALATTLTLSSPTTKPQKVNPFPFFSNQKTRFLTKQTRPRSRRSLSLTPARVAAPPSTVEADQSYPETENNETEEEFNDESSYSKFTWRDHWYPVSLIEDLNPLLPTPFQLLGREIVLWYDKSISQWVAFDDKCPHRLAPLSEGRIDEDGKLQCSYHGWSFDGCGSCVKIPQAASEGPEARAIGSPKACATRFPTMVSQGLLFVWPDENGWEKAKASKPPMLPDDFDKPEFATVNIQRDLFYGYDTLMENVSDPSHIEFAHHKVTGRRDRAKPLPFKMDSRGSWGFSGANEGNPQISAKFVAPCYMMNKIQIDTKLPVVGDQKWVVWICSFNVPMAPGKTRSIVCSARNFFQFSVPGPAWWQVVPRWYEHWTSNKVYDGDMIVLQGQEKIFLSETKEGGDINKQYTNITFTPTQADRFVLAFRNWLRRHGNGQPEWFGNSSDQPLPSTVLSKRQMLDRFEQHTLKCSSCKAAYEGFQTWQKVLIGTTVVFCATSGIPSDVQLRVLLAGLAIVSAAITFALNQLQKNFEFVDYVHAEIDX

SEQ ID NO: 10448 - protein, 116 aa, Zea mays
ALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGLADWQSSQHPWIYEK

SEQ ID NO: 10449 - protein, 149 aa, Zea mays; identical to SEQ ID NO: 5266

SEQ ID NO: 10450 - protein, 453 aa, Glycine max
  misc_feature (453)..(453): Xaa can be any naturally occurring amino acid
  unsure (1)..(453): unsure at all Xaa locations
EYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVKX

SEQ ID NO: 10451 - protein, 422 aa, Glycine max
  misc_feature (422)..(422): Xaa can be any naturally occurring amino acid
  unsure (1)..(422): unsure at all Xaa locations
MTSHSHYPPDLDADSVTSSPRSDHFHDAPPRIRFMCSFGGKILPRPHDNQLRYVGGDTRIVAVNRSITFSALILKLSKLSGMSNITAKYQLPNEDLDALISVTTDEDVENMMDEYDRVAHNQNPRSARLRLFLFPEGEDSRASSISSLLNGSAKRENWFLDALNGGVSGLERGRSEASSMVSEVPDYLFGLDNSEEITNHQRDPRPKPGPIIQDNVSVSDPGSPAPVVSSPYCSTSSAPPVPSLPNLPYVKTKPLNLNPVPDTDSKENQTEPETEPHPNLNLNQNPNMYSNNPVVHYPPEAAYSAHSVNPVPVYYVSGPVRPGSVPVPMQTPYHYVQQSYHAVVPPQVPIGYHPLVPGSGQVYGAGVRHMTPLQPYSPSTTAVVHDGLKQHVYHAVPNSGPVPVHPVIPMTGLDEPQRGGAX

SEQ ID NO: 10452 - protein, 146 aa, Glycine max
  misc_feature (146)..(146): Xaa can be any naturally occurring amino acid
  unsure (1)..(146): unsure at all Xaa locations
MPVPLAPYPTPPAPYTPPANGVQSQLVCSGCRNLLVFPVGATSVCCAVCNAVTAVPPPGTEMAQLVCGGCHTLLMYIRGATSVQCSCCHTVNLALEANQVAHVNCGNCRMLLAYQYGARSVKCAVCNFVTSVGATASTTEQKFSTX

SEQ ID NO: 10453 - protein, 514 aa, Glycine max
  misc_feature (514)..(514): Xaa can be any naturally occurring amino acid
  unsure (1)..(514): unsure at all Xaa locations
MLPRSRTLPSRIHQGIIEERHDVRPYVQVEVRPNNIQTETQAMNIQSNYSKCFDDDGRLKRTGTFWTATAHIITAVIGSGVLSLAWAVAQLGWVAGPVVMFLFAVVNLYTSNLLTQCYRTGDSVNGHRNYTYMEAVKSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKTFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSYX

SEQ ID NO: 10454 - protein, 346 aa, Glycine max
  misc_feature (346)..(346): Xaa can be any naturally occurring amino acid
  unsure (1)..(346): unsure at all Xaa locations
FYSILLQFKSNFQTMASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTFGEHGSRYYTKNFHGSVEAFHVSTVDTTGAGDSFVGALLSKIVDDQSVLEDEARLREVLKFANACGAITTTKKGAIPALPTEADALNLIKEAX

SEQ ID NO: 10455 - protein, 275 aa, Glycine max
  misc_feature (275)..(275): Xaa can be any naturally occurring amino acid
  unsure (1)..(275): unsure at all Xaa locations
LSSRSCKKKKNTMAASAPTPREEFVYMAKLAEQAERYEEMVEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQNX

SEQ ID NO: 10456 - protein, 637 aa, Glycine max
  misc_feature (637)..(637): Xaa can be any naturally occurring amino acid
  unsure (1)..(637): unsure at all Xaa locations
MMESCDCIDTQYPPDELLVKYQYISDVLIALAYFSIPVELIYFVQKSAFFPYRWVLMQFGAFIVLCGATHFINLWTFSPHSKSVAVVMTIAKVSCAIVSCATALMLVHIIPDLLSVKRRESILKNKAEELDREMGLILTQEETGRHVRMLTHEIRSTLDRHTILKTTLVELGRTLGLEECALWMPSRSGLNLQLSHTLTYHVQVGSTVQTNNPIVNEVFNSPQAMRIPPTCPLARIRPLVGRYVPPEVVAVRVPLLNLSNFQINDWPDISAKSYAIMVLILPTDSVRKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTATFIVKLGICGNPDPSDHQAANRSQAYSGSGGLARFKPFITDENDTGFSTRRNQRSFX

SEQ ID NO: 10457 - protein, 240 aa, Glycine max
  misc_feature (240)..(240): Xaa can be any naturally occurring amino acid
  unsure (1)..(240): unsure at all Xaa locations
AIREPRVVVQTTSEVDILDDGYRWRKYGQKVVKGNPNPRSYYKCTNAGCTVRKHVERASHDLKSVITTYEGKHNHDVPAARASSHVNANASNAVPGQASLQTHVHRPEPSEVHNGIGRLERPSLGSFNLPGRQQLGPSHGFSFGMNQSMLSNLVMSGLGHAQAKLPVMPVHSFLAAHQQQQQHQQQQNQQQRAANDLGFMLPKGEPNVEAIPERGGLNLSNGSSVYQEIMSRMPLGPHMX

SEQ ID NO: 10458 - protein, 438 aa, Glycine max
  misc_feature (438)..(438): Xaa can be any naturally occurring amino acid
  unsure (1)..(438): unsure at all Xaa locations
RVRFPLLVLLGTVFLASVCVSLKVREDENNPFYFRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10459 - protein, 368 aa, Glycine max
  misc_feature (368)..(368): Xaa can be any naturally occurring amino acid
  unsure (1)..(368): unsure at all Xaa locations
AIAMVKSNENGSGSVSVPPFLKKCYDMVEDRNTDSIIRWSDGGDSFVISDITQFSVTLLPTYFKHNNFSSFIRQLNIYGFRKIDTDCWEFANENFVRGQKHLLKNIRRRKHPHSADQQKALPQQDNCDEPSQEAPYHGLWKEVENLKLDKNSLTQELVKLRQHQESAENKLLLLSDRLQGMEKHQQQMLSFLVMVVQSPGFMVQLLHPKENNWHLAESWNILDQDKQDDKPVASDGMIIKYKPPVGEKLKPVVPLSPGFEKQTEPELSAEGLKDLCVSSEFLKVLLDEKLSPLENHSPFLLPDLPDDGSWEQLFLGSPFMGNIQDSNKESEGHTNGGMEMEPTISETPNENSRTFESMIVEMEKTREX

SEQ ID NO: 10460 - protein, 334 aa, Glycine max
  misc_feature (334)..(334): Xaa can be any naturally occurring amino acid
  unsure (1)..(334): unsure at all Xaa locations
MSKARVYTDVNVLRPKEYWDYESLTLQWGDQDDYEVVRKVGRGKYSEVFEGINVNSNERCIIKILKPVKKKKIKREIKILQNICGGPNIVKLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQX

SEQ ID NO: 10461 - protein, 610 aa, Glycine max
  misc_feature (610)..(610): Xaa can be any naturally occurring amino acid
  unsure (1)..(610): unsure at all Xaa locations
EICRYLYNHQNKDGGWGLHIEGPSTMFGSVLSYITLRLLGEGPNDGQGEMEKARDWILGHGGATYITSWGKMWLSVLGVYEWSGNNPLPPEIWLLPYMLPFHPGRMWCHCRMVYLPMSYLYGKRFVGPISPTVLSLRKELYTVPYHDIDWDQARNLCAKEDLYYPHPLVQDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIEEFGPTIRKAHTYIKNSQVLEDCPGDLNKWYRHISKGAWPFSTGDHGWPISDCTAEGLKAVLLLSKIAPEIVGEPIDVKRLYDSVNVILSLQNEDGGFATYELKRSYNWLEIINPAETFGDIVIDYPYVECTSAAIQALASFRKLYPGHRREEIQHCIDKATTFIEKIQASDGSWYGSWGVCFTYGAWFGVKGLIAAGRSFSNCSSIRKACEFLLSKQLPSGGWGESYLSCQNKVYSNLEGNRSHVVNTGWAMLALIDAGQAKRDSQPLHRAAAYLINSQLEDGDFPQQEIMGVFNKNCMITYAAYRNIFPIWALGEYQSQVLQSRX

SEQ ID NO: 10462 - protein, 293 aa, Glycine max
  misc_feature (293)..(293): Xaa can be any naturally occurring amino acid
  unsure (1)..(293): unsure at all Xaa locations
VSSAAMAIQDQNGFFRSQGGPPEGGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLMKFKLPPNGCVSIKEDNTAEESSGRTFKLFGMTLFVTDTCKPSPTIEECX

SEQ ID NO: 10463 - protein, 514 aa, Glycine max
  misc_feature (514)..(514): Xaa can be any naturally occurring amino acid
  unsure (1)..(514): unsure at all Xaa locations
MLPRSRTLPSRIHQGIIEERHDVRPYVQVEVRPNNIQTETQAMNIQSNYSKCFDDDGRLKRTGTFWTATAHIITAVIGSGVLSLAWAVAQLGWVAGPVVMFLFAVVNLYTSNLLTQCYRTGDSVNGHRNYTYMEAVKSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKTFKGSLMGISIGTVTQAGTVTSTQKIWRSLQALGAMAFAYSFSIILIEIQDTIKFPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSYX

SEQ ID NO: 10464 - protein, 380 aa, Glycine max; identical to SEQ ID NO: 10391
  misc_feature (380)..(380): Xaa can be any naturally occurring amino acid
  unsure (1)..(380): unsure at all Xaa locations

SEQ ID NO: 10465 - protein, 512 aa, Glycine max
  misc_feature (512)..(512): Xaa can be any naturally occurring amino acid
  unsure (1)..(512): unsure at all Xaa locations
MEAPSLTKPNDPTKPSNTSSTLSLEGGPGEASPLRKMFAVASIAAGIQFGWALQLSLLTPYVQLLGVPHAAASFIWLCGPISGLVVQPIVGYYSDHCTSRFGRRRPFILGGALAVAIAVFLIGYAADIGHSAGDDITKKTRPRAVGVFVIGFWILDVANNMLQGPCRAFLADLAAGDQQKTRIANGFFSFFMAVGNVLGYAAGSYSGLHKIFPFTETKACDVFCANLKSCFFFSILLLLFLATVALLYVKDKQVEAIPLDDATQPSCFFQLFGALKELKRPMWMLMLVTAVNWVGWFPYFLFDTDWMGREVYGGTAGEDAYAKGVRVGSLGLMVNAVVLGFMSLAVEPLGKMVGGVKRLWAIVNFILAIGFGMTVVITKVAEHQRRMNPAAVGHPSEGVVVGSMVFFGVLGVPLAITFSVPFALASIYCSASGAGQGLSLGVLNLAIVVPQMVVSALSGPWDSLFGGGNLPAFMVGAAAAALSAIMAIVLLPTPKPADEAKASSMMAGGFHX

SEQ ID NO: 10466 - protein, 302 aa, Glycine max
  misc_feature (302)..(302): Xaa can be any naturally occurring amino acid
  unsure (1)..(302): unsure at all Xaa locations
GYVLGLRVSPQHRRKGIGSSLVRTLEEWFTSKDVDYAYMATEKDNHASVSLFMDKFGYTKFRTPAILVNPVNHHCFQISPNIEIARLKIDQAEYLYRRFMGSTEFFPNDIGNILRNKLSLGTWVAYFKGDIAWGDFGSDGQVPNSWAMLSVWNSGEIFKLRLGKAPFSCLVCTKSWWLIHKIFPCLKLPTIPDFFNPFGFYFMYGVHHEGPFSGKLVRALCQFVHNMGAESKDESNCRIIVTEVGGRDELNHHIPHWKLLSCPEDLWCIKALKNEGTNNKFHELTTKTPPTRALFVDPREVX

SEQ ID NO: 10467 - protein, 257 aa, Glycine max
  misc_feature (257)..(257): Xaa can be any naturally occurring amino acid
  unsure (1)..(257): unsure at all Xaa locations
MEAVRAGREGAIGLGQGDGVAKDSTETELTKIRLLRAIVETRDPSSKEEDDFMIRRFLRARDLDVEKASAMLLKYLKWRNSFVPNGSVSVSDVPNELAQDKVFMQGHDKIGRPILMVFGGRHFQNKDGLDEFKRFVVYVLDKVCASMPPGQEKFVGIAELKGWGYSNSDVRGYLSALSILQDYYPERLGKLFIVNAPYIFMKVWQIVYPFIDNKTKKKIVFVEKNKVKSTLLEEMEESQVPEIFGGSLPLVPIQDSX

SEQ ID NO: 10468 - protein, 495 aa, Glycine max
  misc_feature (495)..(495): Xaa can be any naturally occurring amino acid
  unsure (1)..(495): unsure at all Xaa locations
EREMAGIAGTCPLGALLRNSVSENNGKISVVHYEGLRLQQRMQMPSPSQYISASSSAPRCRTIKAMASPTVGAPKREKDPKKRVVITGMGLVSVFGSDVDAFYNKLLEGESGISLIDRFDASNFSVRFGGQIRDFSSEGYIDGKNDRRLDNCWRYCIVAGKRALDDANLGKQVLDTMDKTRIGVLVGSGMGGITAFSNGVEALVQKGYKKITPFFIPYSITNMGSALLAIDTGLMGPNYSISTACATANYCFCAAANHIRKGEADIMVVGGTEAAIMPSGLGGFIACRALSHRNEDPKKASRPWDKDRDGFVMGEGSGVLVMESLESATKRGAKIIAEYLGGAITCDAHHMTDPRADGLGVSSCISKSLEDAGVSPEEVNYVNAHATSTLAGDLAEVNAIKKVFKDTSELKMNATKSMIGHGLGAAGGLEAIATIKAITTGWLHPSINLDNLEASVTIDTVPNVKKKHEVNVGISNSFGFGGHNSVVVFAPFRPX

SEQ ID NO: 10469 - protein, 392 aa, Glycine max
  misc_feature (392)..(392): Xaa can be any naturally occurring amino acid
  unsure (1)..(392): unsure at all Xaa locations
MEFNKFRIRSYEGQSDRAQVEDLERRCEVGPSESVFLFTDTMGDPICRIRNSPMYMMLVAELDNELVGVIQGSIKVVTVHGHPPKDLAKVGYVLGLRVSPQHRRKGIGSSLVRTLEEWFTSKDVDYAYMATEKDNHASVSLFMDKFGYTKFRTPAILVNPVNHHCFQISPNIEIARLKIDQAEYLYRRFMGSTEFFPNDIGNILRNKLSLGTWVAYFKGDIAWGDFGSDGQVPNSWAMLSVWNSGEIFKLRLGKAPFSCLVCTKSWWLIHKIFPCLKLPTIPDFFNPFGFYFMYGVHHEGPFSGKLVRALCQFVHNMGAESKDESNCRIIVTEVGGRDELNHHIPHWKLLSCPEDLWCIKALKNEGTNNKFHELTTKTPPTRALFVDPREVX

SEQ ID NO: 10470 - protein, 374 aa, Glycine max
  misc_feature (374)..(374): Xaa can be any naturally occurring amino acid
  unsure (1)..(374): unsure at all Xaa locations
MMDRRHCYKDLLPLVVLVANECNNTGLFTLFKAATLQGMSNYVFVTYAYSVAFLVLLPVTFFYRRSRVVPPLTFSILSKIALLGVIGCSSQILGYAGIRYSSPTLSSAISNLTPAFTFVLAVICRMEKIAVKRRTTQAKILGSIISVLGAFVVTFYKGQSVIIADNSPSIQLPQSNGILTSVDRNWVIGGLLLTACNILLTVWFVYQVEILKEFPDELSMVFFYNLCAAIVASIVGLLGEKNSSAWKIRPDISLISIVCTGIFNKFLSSAIYAWGIHLKGPVYVAMFKPLSIVIAVAMGVMFLGDSLYVGSIIGATIISIGFYTVMWGKATEQKEEEGEEENVGSQESSITENVPLLQSYITVNSTKKIDGSVX

SEQ ID NO: 10471 - protein, 393 aa, Glycine max
  misc_feature (393)..(393): Xaa can be any naturally occurring amino acid
  unsure (1)..(393): unsure at all Xaa locations
LLSSMADSGSASSSRMWCSIPERVQLHAAMLALQFGYAGFHVVSRAALNMGISKLVFPVYRNIIAFLLLLPFAYFLEKKERPAITLNFLLQFFLLALVGITANQGFYLLGLDNTSPTFASAIQNSVPAITFLMAVILRIEQVRLNRKDGIAKVAGTIFCVAGATVITLYKGPTIYSPSPPLQSESSVVVEFGTLSSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASLALGEEFYLGGIIGAVLIVVGLYFVLWGKSEERKFAKEHAAITSTPEHSGIRSSSHAKTLLTQPLLPSSTENVX

SEQ ID NO: 10472 - protein, 290 aa, Glycine max
  misc_feature (290)..(290): Xaa can be any naturally occurring amino acid
  unsure (1)..(290): unsure at all Xaa locations
GLHFATTTLLTVFLKWLGYVQTSHLPLPDLIKFVLFANFSIVGMNVSLMWNSVGFYQIAKLSMIPVSCFLEVILDNVRYSRDTKLSISLVLLGVAVCTVTDVSVNAKGFIAAAVAVWSTSLQQYYVHFLQRKYSLGSFNLLGHTAPVQAASLLLVGPFLDYWLTNKRVDAYNYGFTSTLFIIISCTIAVGTNLSQFICIGRFTAVSFQVLGHMKTILVLALGFVFFGKEGLNLQVILGMTIAIAGMIWYGNASSKPGGKERLSLPINHTTNKTQEYNVLPVSSETDQEIX

SEQ ID NO: 10473 - protein, 658 aa, Glycine max
  misc_feature (658)..(658): Xaa can be any naturally occurring amino acid
  unsure (1)..(658): unsure at all Xaa locations
APKTEQNRGSTPPLLLMDPPPLSAATQKNHPESVESFSPCFRVAETWTDETLPAVPGAKLRLMCSYGGHIMPRPHDKSLSYIGGDTRIVVVDRHSSLKDLCSRLSRTILNGRPFTLKYQLPNEDLESLITVTTDEDLDNMVEEYDRIMAKGSASSRLRVFLFFTKPEATVSMGSLLDDAKSETWFVDALNNSGMISRVVSDSAAGDSFVNLDGVGVGGVSASGSSNNLESLPDANKVKNFPEVVQVQSTPGSPMMENSSSSPSFSPSLVNLPPIRVHVDDNGSRLQQENKVGLVVEEQFAQMTIASGVKPDDGLVNVVSSAVAVPVIPASVTMASAGVITTSDNVMNRVVCEDDRSDPGFQKPPLPLQLVQPRTSGGVGLPSPDSVASDSSIAAANSFSKTVYYQDQVQAALLDNKIVAMPNAKSEISDQMIQVQGQLQDSGYTLPPQLDPNKQHFQQQKPFVHASTHYIHHPAATGPVPVSSYYPVYAPPQPQQLHPPIGQQQYPVYVMPVGPTQVTQPYNMALQPNIADPNVVASSRSLMPQSIVTSAAYKDGTPPIYPTKSVSSTMASNSGYAPIPTNQFQPQYVGLHQFHHPPQSIAVAPSSTTTNNNYGYEYGGHVQDQAYYTQQTTTAPLLPQYQSMTPAAAAAALSDASKX

SEQ ID NO: 10474 - protein, 564 aa, Glycine max
  misc_feature (564)..(564): Xaa can be any naturally occurring amino acid
  unsure (1)..(564): unsure at all Xaa locations
MGQSVSSAAVASRRERDQGHRSVNSSKTRFTASVSPMAGYSSGAAEEGENHRVEAVADESTDYISDLPNECLASVFQFLSSADRSRCSLVCRRWLQIEGQSRHRLSLNAELDLFPAIPSLFSRFDSVTKLALKCDRRSVSIRDDALVLISQRCPNLTRLKLRACRELTDAGMEAFAKNCKGLKKLSCGSCTFGSKGMNAVLDNCAALEELSVKRLRGIADTAAAEPIGPGVAAASLKTVCLKELYNGQCFGTLILGAKNLKTLKLFRCSGDWDRLFQLLVDRVTKIVEVHLERLQISDVGLQAIANYSSLEILHLVKTPECSDIGLVAIADRCKLLRKLHIDGWKANRIGDEGLIAVAKGCPNLLELVLIGVNPTKASLEMLASNCQNLERLALCGSDSVGDPEISCIAAKCVALKKLCIKSCPVSDQGMEALGNGCPNLVKVKVKKCKGVTPEGGDWLRRTRGSVAVNLDTGEAELQEASASDGGAQDNGVEFPQMPAQIAAASSSTRSSSSRFALMSARISAAALRSTRSGSSRLGLLPTRISAASTFRRWSGGSTSARHGX

SEQ ID NO: 10475 - protein, 264 aa, Glycine max
  misc_feature (264)..(264): Xaa can be any naturally occurring amino acid
  unsure (1)..(264): unsure at all Xaa locations
GVITPLSEQLTKPLPNAMVLVNLKEISSRAYKLLPQGTRLVVSVRGDEPYEELDILKGIDATMLLHDLPYTEDKISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEEX

SEQ ID NO: 10476 - protein, 612 aa, Glycine max
VSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMS

SEQ ID NO: 10477 - protein, 250 aa, Zea mays
  misc_feature (250)..(250): Xaa can be any naturally occurring amino acid
  unsure (1)..(250): unsure at all Xaa locations
MTETREINVFMAKLAEQAERYDEMVEAMKNVADLGQELTVEERNLLSVAYKNVIGARRASWRIITSIEQKEESKGNTAHVERIKEYRKKVENEVSKICADVLGTLDNKLIPNAQTTESKVFYYKMKGDYHRYLAEFATSEARKEAADNSLAAYKSATDIANSELAPTHPIRLGLALNASVFYYEIMGSPKQACELARKAFDDAIAELDQLNEESYKDSTLIMQLLRDNLTLWTSDLEGDKADAEPEAANX

SEQ ID NO: 10478 - protein, 291 aa, Zea mays
  misc_feature (291)..(291): Xaa can be any naturally occurring amino acid
  unsure (1)..(291): unsure at all Xaa locations
NNMGFVKLIKTKAYFKRYQVKFRRRREGKTDYRQRTRLITQDKNKYNTPKYRLVVRKTNKNIIAQIIYATVQGDRVVNAAYSSELPKFGIKLGLTNYASAYATGLLVARRHLTKIGLASKYQGKVEADGNDYTVEPAEGPRPFKALLDIGLARTSTGARIFAVAKGALDGGINIPHSVKRFAGYNAETKKHNPEVLKKYIYGQHVAEYMKKLQKEEPQAYEKQFSRFVKAGVKAGDIEGIYKNAHKAIRADPTKKANEKKAVEHKRYNPKRLTHAQRAERVAKKKAILGLX

SEQ ID NO: 10479 - protein, 627 aa, Glycine max
  misc_feature (627)..(627): Xaa can be any naturally occurring amino acid
  unsure (1)..(627): unsure at all Xaa locations
RLLNHHMAVTKEKEDVRNTGKRLKCMRNEEEEVYEEEESELPLKPGFFFYPTTPTSFVVSDALEPDFPIIYVNKVFEISTGYRADEALGRNCRFLQYRDPRAQRRHPLVDPVVVSEIRRCLEEGVEFQGELLNFRKDGTPLVNRLRLAPIHDDDGTVTHVIGIQLFSEANIDLNRVSYPVFKETCNQDFDKTGKYNPKSGQSLYSQHQEMCGILQLSDEVLAHNILSRLTPRDVASIGSVCRRIRQLTKNEHVRKMVCQNAWGKEVTGTLELMTKKLGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDAGVLLSDTYLLDLTTDNPTWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRQDSDLX

SEQ ID NO: 10480 - protein, 442 aa, Glycine max
  misc_feature (442)..(442): Xaa can be any naturally occurring amino acid
  unsure (1)..(442): unsure at all Xaa locations
QDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10481 - protein, 247 aa, Glycine max
  misc_feature (247)..(247): Xaa can be any naturally occurring amino acid
  unsure (1)..(247): unsure at all Xaa locations
MAEDLVLDTAIRDWVLIPLSVVMVLIGVLRYFVSKLMHSSQTPDAKIVKEGQVIVRARNLRAGANFIPSKAFRARKIYFCNEENGLLFVPKGQGQNPQAQMFSDPNMAMDMMKKNLSMIIPQTLTFAWVNFFFSGFVAAKIPFPLTQRFRSMLQNGIDLSTVDVSYVSSRSWYFLNLFGLRGLFSLILGEENAVDDTQRMMQMGGFGFDPSKGLSAEKDNLDITQHDWALPNFEQRAEAVLRKVASX

SEQ ID NO: 10482 - protein, 320 aa, Glycine max
  misc_feature (320)..(320): Xaa can be any naturally occurring amino acid
  unsure (1)..(320): unsure at all Xaa locations
VKPDDRDPYYLDRGYAQRIPAGTTVYLVNPDKKKDLRVIKLAIPVNKPGNFEDFFLSSTQDQQSYLQGFSENILEASFNTKFEEINRVLFGGEGRRHQQEGVILELSKEQIRELSKRAKSSSRSTNSFDYEPFYLRGSQISSNNFGKFYEITPEKNPQLRDFDILLNTVDINEGGLLLPHYNSKAIVILMVTEGEANIELVGLKEQQQGEETREVRKYRAELSEDDIFVIPAAYPFVVNATSNLNFVAFGINAENNQRNFLAGSKDNVIRQIQKQVKELAFPAGSAQDIENLIKNQRESYFADAQPLQKEEGKKGSFVFX

SEQ ID NO: 10483 - protein, 351 aa, Glycine max
  misc_feature (351)..(351): Xaa can be any naturally occurring amino acid
  unsure (1)..(351): unsure at all Xaa locations
MENAPVVCKEDDQMDLPPGFRFHPTDEELISHYLYKKVIDTKFCARAIGEVDLNKSEPWDLPWKAKMGEKEWYFFCVRDRKYPTGLRTNRATEAGYWKATGKDKEIFRGKSLVGMKKTLVFYRGRAPKGEKSNWVMHEYRLEGKFSVHNLPKTAKNEWVICRVFQKSSAGKKTHISGIMRLDSFADELGSSALPPLSDSSPSIGNTKPLNDTAYVPCFSNPIDVQRNQEGVFDSFTNSIYAVSSNPMGILPRMPPSGSFYSTQGVQAAPNLAFPGSVYTLQDHTILRTLCENNGYKPERDMISVSQETGLTTDINAETSSNFDMGRRPFENHNHASVSVAPLDLDGLWNYX

SEQ ID NO: 10484 - protein, 382 aa, Glycine max
  misc_feature (382)..(382): Xaa can be any naturally occurring amino acid
  unsure (1)..(382): unsure at all Xaa locations
MCFCCQSLDCHFSAAVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEEX

SEQ ID NO: 10485 - protein, 456 aa, Zea mays
  misc_feature (456)..(456): Xaa can be any naturally occurring amino acid
  unsure (1)..(456): unsure at all Xaa locations
MGTQAPEKENYPPEKDARSAREKAIDEWLPITSSRNAKWWYSAFHNVTAMVGAGVLSLPYALSELGWGPGIAVLVVSWVITLYTLWQMVEMHEMVPGKRFDRYHELGQHAFGEKLGLWIVVPQQLVVEVGVNIVYMVTGGRSLKKFHDVLVCGDGGASCQGKDNIKTTYFIMIFASVHFVLSQLPNFNSISGVSLAAAVMSLSYSTIAWGASVDKGRMAGVDYHLRATTTPGKVFGFFGALGDVAFAYAGHNVVLEIQATIPSTPEKPSKKPMWKGVVVAYVVVALCYFPVALIGYWAFGNSVQDNILITLSRPRWLIALANMMVVIHVIGSYQIYAMPVFDMIETVLVKKLRFPPGLTLRLISRTAYVAFTMFIAITFPFFGGLLGFFGGFAFAPTTYFLPCVMWLAIYKPKRFSLSWFTNWICIILGVILMILSPIGGLRQIIMDAKTYQFYSX

SEQ ID NO: 10486 - protein, 480 aa, Glycine max
  misc_feature (480)..(480): Xaa can be any naturally occurring amino acid
  unsure (1)..(480): unsure at all Xaa locations
MMENGGKQTFEVSNDTLQRVGSKSFDDDGRLKRTGTIWTASAHIITAVIGSGVLSLAWAIAQLGWIAGPVVMILFSIVTYYTSTLLATCYRSGDQLSGKRNYTYTQAVRSYLGGFSVKFCGWVQYANLFGVAIGYTIAASISMMAIKRSNCYHSSGGKNPCKMNSNWYMISYGVSEIIFSQIPDFHELWWLSIVAAVMSFTYSFIGLGLGIGKVIGNGRIKGSLTGVTIGTVTESQKIWRTFQALGNIAFAYSYSMILIEIQDTIKSPPAESETMSKATLISVLVTTVFYMLCGCFGYASFGDASPGNLLTGFGFYNPFWLIDIANAGIVIHLVGAYQVYCQPLFSFVESNAAERFPNSDFMSREFEVPIPGCKPYKLNLFRLVWRTLFVILSTVIAMLLPFFNDIVGLIGAIGFWPLTVYLPVEMYITQTKIPKWGIKWIGLQMLSVACFVITILAAAGSIAGVIDDLKVYKPFVTSYX

SEQ ID NO: 10487 - protein, 695 aa, Glycine max
  misc_feature (695)..(695): Xaa can be any naturally occurring amino acid
  unsure (1)..(695): unsure at all Xaa locations
FFIRMAAPLACLVGSGLSIQSNKLTLGKDVNGRYLFSYHRLSAQSKESKTICIKASLDQRKHEGRRGFLKLLNVGVGLPVLLGGGKAYADEQGPSSSRMSYSRFLEYLDKGRVKKVDLFENGTSAVVEAVSPELGNRVQRVRVQFPGLSQELLQKFREKNIDFAAHNGQEETGSPLANLIGNLAFPLILIGGLFLLSRRSSGGMGGPGGGFPLAFGQSKAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFRKAKENAPCIVFVDEIDAVGRQRGTGIGGGNDEREQTLNQLLTEMDGFEGNTGIIVIAATNRVDILDSALLRPGRFDRQVTVDVPDIRGRTEILKVHGSNKKFEADVSLEVIAMRTPGFSGADLANLLNEAAILAGRRGKTAISSKEIDDSIDRIVAGMEGTVMTDGKSKSLVAYHEVGHAICGTLTPGHDPVQKVTLVPRGQARGLTWFIPADDPTLISKQQLFARIVGGLGGRAAEEVIFGEPEVTTGAAGDLQQITSLAKQMVTTFGMSDIGPWSLMDSSAQSDVIMRMMARNSMSEKLAEDIDAAVKRLSDEAYEIALSQIRSNREAIDKIVEVLLEKETMSGDEFRALLSEFVEIPAENRVPPSTPSPVVVX

SEQ ID NO: 10488 - protein, 169 aa, Glycine max
IFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRVI

SEQ ID NO: 10489 - protein, 504 aa, Glycine max
  misc_feature (504)..(504): Xaa can be any naturally occurring amino acid
  unsure (1)..(504): unsure at all Xaa locations
NHGSLSDRIMSYYGDSPRGMVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMIASELQKGVEPFEEKHRHYFDFQRRSGQLPVQKEGEEVDYRGVLHRDGSVLMSVSLDQLKMPEVLYKSLAAKLIVGMPFKDLATVDSILLREVPPVDDADARLALKRLIDISMGVITPLSEQLTKPLPNAMVLVNLKEISSRAYKLLPQGTRLVVSVRGDEPYEELDILKGIDATMLLHDLPYTEDKISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEEX

SEQ ID NO: 10490 - protein, 462 aa, Glycine max
  misc_feature (462)..(462): Xaa can be any naturally occurring amino acid
  unsure (1)..(462): unsure at all Xaa locations
MAVQNSLQITRSGSGGYDDDGRAKRTGTLWSAVAHIITAIIGAGVLSLAWSTSQLGWIAGPVCLLFCAIVTYVSSFLLSDCYRTLDPVTVKRNYSYMDAVRVYLGNKRTWLAGSLQYLSLYGVSTAYVITTATCLRAILKSNCYHKEGHQAPCKYGDVVYMMLFGLVQVIMSFIPDLHNMAWVSIVAAIMSFTYSSIGLGLGITTVIENGRIMGSLTGVPASNIADKLWLVFQAIGDIAFAYPYTVILLEIQDTLESPPPENKTMKKASMIAILITTFFYLCCGCFGYAAFGNQTPGNLLTGFGFYEPYWLIDFANACIVLHLVGGYQIYSQPIYGAVDRWCSKRYPNSGFVNNFYQLKLPRLPAFQLNMFRICFRTTYVVSTTGLAILFPYFNQVIGVLGALGFWPLAIYFSVEMYFVQRKIEAWSRKWIVLRTFSFICFLVSLVALIGSLEGIISEKLSX

SEQ ID NO: 10491 - protein, 204 aa, Oryza sativa
  misc_feature (204)..(204): Xaa can be any naturally occurring amino acid
  unsure (1)..(204): unsure at all Xaa locations
APNRHAGREERTTSHRARPNRRSCFPEEKNMSRHPSTKWAQRSDKVFLTIELPDARDVKLNLKPEGQFIFSAKGPADDTPYELDLELFDAVNVEESKAAVAARSICYLIKKAESKWWPRLLKKEGKPPVFLKVDWDKWQDEDDEDIGLGDFGDMDFSKLGMGGPDDDLEDDDEDDTADSANKDDEDIKAEGSGEQEAAGEAKPX

SEQ ID NO: 10492 - protein, 621 aa, Oryza sativa
  misc_feature (621)..(621): Xaa can be any naturally occurring amino acid
  unsure (1)..(621): unsure at all Xaa locations
IDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENAIMDELRKRADADKNDKSVKDLVMLLFETALLTSGFSLEDPNTFGTRIHRMLKLGLSIDEDESAEADADMPPLEDDAGESKMEEVDX

SEQ ID NO: 10493 - protein, 689 aa, Zea mays
MASADVHMAGGAETETFAFQAEINQLLSLIINTFYSNKEIFLRELISNASDALDKIRFESLTDKSKLDAQPELFIRLVPDKASKTLSIIDSGVGMTKSDLVNNLGTIARSGTKEFMEALAAGATDVSMIGQFGVGFYSAYLVADRVMVTTKHNDDEQYVWESQAGGSFTVTHDTTGEQLGRGTKITLFLKDDQLEYLEERRLKDLVKKHSEFISYPIYLWTEKTTEKEISDDEEEEDNKKEEEGDVEEVDDEDKDTKDKSKKKKKVKEVSHEWVQINKQKPIWLRKPEEITRDEYASFYKSLTNDWEDHLAVKHFSVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDETTSLKDYVTRMKEGQKDIYYITGESRKAVENSPFLERLKKKGYEVLFMVDAIDEYAVGQLKEYDGKKLVSATKEGLKLDDEDDEEAKKRREERKKRFEELCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDED

SEQ ID NO: 10494 - protein, 659 aa, Zea mays
EGRLDMASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWIEKTTEKEISDDEDEEDKKDEEGKVEDVDEKEEKEKKKKKIKEVSHEWQLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPDNAIMEELRKRAEADKNDKSVKDLVMLLFETALLTSGFSLDDPNT

SEQ ID NO: 10495 - protein, 273 aa, Zea mays
  misc_feature (273)..(273): Xaa can be any naturally occurring amino acid
  unsure (1)..(273): unsure at all Xaa locations
MDPSAVSFDSGGTRRGGGAQMLLFGGGGSANSNGFFRGVPMAVLGMDDATRVGKRAFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDNLRAQVISLTEKLQGKETYPSATTAAQEVDQPDEHTAVSGTEELLAQQLKDNLHSSGDCTGHGTLSSEEDDGGVVSDEGCSFALPDAMFAAGFTHHGAEEVQLANWTSMFWNX

SEQ ID NO: 10496 - protein, 450 aa, Zea mays
  misc_feature (450)..(450): Xaa can be any naturally occurring amino acid
  unsure (1)..(450): unsure at all Xaa locations
FFLSHRSPIARAGDDGSYKVLSMGSPRTDSVCSQSKAVPSSSAGAATVPLHHRHGPCSPLPTKKMPTLEETLHRDQLRAAYIQRKFSGGGGAGGDVQRSDATVPTALGTSLNTLEYLITVGLGSPATSQTMLIDTGSDVSWVQCKPCSQCHSQADPLFDPSSSSTYSPFSCGSADCAQLGQEGNGCSSSSQCQYIVTYGDGSSTTGTYSSDTLALGSSAVRSFQFGCSNVESGFNDQTDGLMGLGGGAQSLVSQTAGTLGRAFSYCLPPTPSSSGFLTLGAAGGSGTSGFVKTPMLRSSQVPTFYGVRLQAIRVGGRQLSIPASVFSAGTVMDSGTVITRLPPTAYSALSSAFKAGMKQYPPAQPSGILDTCFDFSGQSSVSIPSVALVFSGGAVVSLDASGIILSNCLAFAGNSDDSSLGIIGNVQQRTFEVLYDVGRGVVGFRAGACX

SEQ ID NO: 10497 - protein, 206 aa, Zea mays
  misc_feature (206)..(206): Xaa can be any naturally occurring amino acid
  unsure (1)..(206): unsure at all Xaa locations
QSSPKTSKPQSLNPRRRPHDAHLRSRGGSMSRHPITKWAQRSDRVFLTIELPDAQDVKLNLKPEGHFNFSAKGSDDLRYEFDIELFDAVNVEESKAAIAPRTICYLIKKAKSGWWPRLLKQEGKPPVFLKVDWDKWQDEDDEDAGFNDFGGMDFSKLDIGGADDDDIGDDEDDVVESANKDEEGGKTEESKEEEAAPAAAEEVKPX

SEQ ID NO: 10498 - protein, 689 aa, Zea mays; identical to SEQ ID NO: 10493

SEQ ID NO: 10499 - protein, 332 aa, Zea mays
  misc_feature (332)..(332): Xaa can be any naturally occurring amino acid
  unsure (1)..(332): unsure at all Xaa locations
FPPFPSPTAQQSVSTRHPHASAPPTGPLQLSDLQESAAEAPAMAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAKX

SEQ ID NO: 10500 - protein, 716 aa, Zea mays
  misc_feature (716)..(716): Xaa can be any naturally occurring amino acid
  unsure (1)..(716): unsure at all Xaa locations
MASADVHMAGGAETETFAFQAEINQLLSLIINTFYSNKEIFLRELISNASDALDKIRFESLTDKSKLDAQPELFIRLVPDKASKTLSIIDSGVGMTKSDLVNNLGTIARSGTKEFMEALAAGATDVSMIGQFGVGFYSAYLVADRVMVTTKHNDDEQYVWESQAGGSFTVTHDTTGEQLGRGTKITLFLKDDQLEYLEERRLKDLVKKHSEFISYPIYLWTEKTTEKEISDDEEEEDNKKEEEGDVEEVDDEDKDAKDKSKKKKKVKEVSHEWVQINKQKPIWLRKPEEITRDEYASFYKSLTNDWEDHLAVKHFSVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDETTSLKDYVTRMKEGQKDIYYITGESRKAVENSPFLERLKKKGYEVLFMVDAIDEYAVGQLKEYDGKKLVSATKEGLKLDDEDDEEAKKRREERKKRFEELCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDEDAAGDEDADMPALDEGAAEESKMEEVDX

SEQ ID NO: 10501 - protein, 203 aa, Zea mays
  misc_feature (203)..(203): Xaa can be any naturally occurring amino acid
  unsure (1)..(203): unsure at all Xaa locations
MASIVASRRAVPLVRALEKLIAASSAPGTGSALRPVAVAGGLRGYNTGAPLRRYEGAESEDDSVREYDGRHGGRDYAVPSLFSGNIFRDPLSAPHSIGRLLNLMDDLAVAAPGRAVRRGWNAKEDEEALHLRVDMPGLGKEHVKVWAEQNSPPPRYSGRIELAPEVYRMDKIKAEMKNGVLKVVVPKVKEQQRKDVFQVNVEX

SEQ ID NO: 10502 - protein, 171 aa, Zea mays
  misc_feature (171)..(171): Xaa can be any naturally occurring amino acid
  unsure (1)..(171): unsure at all Xaa locations
ALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEAX

SEQ ID NO: 10503 - protein, 509 aa, Zea mays
  misc_feature (509)..(509): Xaa can be any naturally occurring amino acid
  unsure (1)..(509): unsure at all Xaa locations
MAGDGMEVSASGGGGGNKQPQISLLGLFLACMVAGGVQYGWALQLSLLTPYVQTLGIPHALTSVMWLCGPIAGLLVQPCVGLYSDKCTSKLGRRRPFIFTGCIIICISVIVIGFSSDIGYALGDTTEDCNVYTGKRLHAALFFVMGFWLLDFSNNTVQGPARALMADLAGSHGPSTANAIFVSWMAIGNILGYSSGSTDKWHTWFPFLQTRACCEACANLKAAFLVSVVFLGLSTVVTMIFAREVPLDPAAAAKQDEAGESSGPFAVFKGMKNMPPGMPQVLIVTGLTWLSWFPFILFDTDWMGREMYHGRPDGSPEEVARFQEGVRQGAFGLLLNSVVLGASSFLIEPMCRKLTAKVVWVMSSFLVCVAMALVTVLSSWSLGDIGGNVQDAAAVDKGLKTTALAIFVFLGFPFAVLCSVPFAVTAQLAAAKGGGQGLCTGVLNISIVVPQMVIAIGSGPWDELFGKGNIPAFGLAAVFAFTAAVAGIIMLPKQPKTSFRSVSMGGGHX

SEQ ID NO: 10504 - protein, 192 aa, Zea mays
  misc_feature (192)..(192): Xaa can be any naturally occurring amino acid
  unsure (1)..(192): unsure at all Xaa locations
LDSAQFFHQALYLGGVTAAPARPTLRLMKQNLAFLSSVLTEQAQLPAVLEVMRASVEAFLTVVLAGGSGRAFARGDHAAVAADFASLKRLFCSFGVGEEAVERETVRAEGVLALMAVPTEQLIHELLGHYASTPMRAAGDELPQLPMMPMTPTARRWSRSDANTVLRVLCYRDDEPANRFLKKTFNLPKRRX

SEQ ID NO: 10505 - protein, 258 aa, Zea mays
  misc_feature (258)..(258): Xaa can be any naturally occurring amino acid
  unsure (1)..(258): unsure at all Xaa locations
RCKQQSSTLSTRPSSSQEPTRTSAIRPAMAAARRLSLPLVLLVVLAVAGRAAAQDYDFFYLVLQWPGAYCDTKQSCCYPKSGKPAADFGIHGLWPNRDDGTYPQNCSPDNAFNPSKVSDLMSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAFX

SEQ ID NO: 10506 - protein, 448 aa, Zea mays
SENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDL

SEQ ID NO: 10507 - protein, 505 aa, Zea mays; identical to SEQ ID NO: 10234
  misc_feature (505)..(505): Xaa can be any naturally occurring amino acid
  unsure (1)..(505): unsure at all Xaa locations

SEQ ID NO: 10508 - protein, 213 aa, Zea mays
VEQYSPIPYVATLLNCMMWVLYGLPAVHPHSMLVITINGTGMAIQLTYVALFLLYSAGAARRKVVLLLAAEVGFVGAVAALVLSLAHTHERRSMVVGILCVLFGTGMYAAPLSVMKMVIQTKSVEYMPLFLSLASLVNGICWTAYALIRFDLYITIPNGLGVLFAVAQLVLYAIYYKSTQEIIEARKRKADQIAMTGVVVDGGKTNNQAGAGQ

SEQ ID NO: 10509 - protein, 223 aa, Zea mays
  misc_feature (223)..(223): Xaa can be any naturally occurring amino acid
  unsure (1)..(223): unsure at all Xaa locations
METMSALARTAPPLAGTIRRPSCALRPTASLSFAAASTTPRGRLGLGLSTAPAGSGRAARARAVPRRIVASSEVEQSYIMIKPDGVQRGLVGEIISRFEKKGFLLKGLKLFQCPKDLAQEHYKDLKDKPFFPKLIDYITSGPVVCMAWEGDGVVASARKLIGATNPLQAEPGTIRGDLAVQTGRNVVHGSDSPDNGKREIELWFKEGEVCQWESVQAPWLIEX

SEQ ID NO: 10510 - protein, 586 aa, Arabidopsis thaliana; identical to SEQ ID NO: 10421
  misc_feature (586)..(586): Xaa can be any naturally occurring amino acid
  unsure (1)..(586): unsure at all Xaa locations

SEQ ID NO: 10511 - protein, 591 aa, Arabidopsis thaliana
  misc_feature (591)..(591): Xaa can be any naturally occurring amino acid
  unsure (1)..(591): unsure at all Xaa locations
MSLPETKSDDILLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCNPTTSSHCEQASGIQLTVLYLALYLTALGTGGVKASVSGFGSDQFDETEPKERSKMTYFFNRFFFCINVGSLLAVTVLVYVQDDVGRKWGYGICAFAIVLALSVFLAGTNRYRFKKLIGSPMTQVAAVIVAAWRNRKLELPADPSYLYDVDDIIAAEGSMKGKQKLPHTEQFRSLDKAAIRDQEAGVTSNVFNKWTLSTLTDVEEVKQIVRMLPIWATCILFWTVHAQLTTLSVAQSETLDRSIGSFEIPPASMAVFYVGGLLLTTAVYDRVVIRLCKKLFNYPHGLRPLQRIGLGLFFGSMAMAVAALVELKRLRTAHAHGPTVKTLPLGFYLLIPQYLIVGIGEALIYTGQLDFFLRECPKGMKGMSTGLLLSTLALGFFFSSVLVTIVEKFTGKAHPWIADDLNKGRLYNFYWLVAVLVALNFLIFLVFSKWYVYKEKRLAEVGIELDDEPSIPMGHX

SEQ ID NO: 10512 - protein, 532 aa, Arabidopsis thaliana
  misc_feature (532)..(532): Xaa can be any naturally occurring amino acid
  unsure (1)..(532): unsure at all Xaa locations
ELQHIEQVFTPLVEKCKKYGRAMRIGTNHGSLSDRIMSYYGDSPRGMVESAFEFARICRKLDYHNFVFSMKASNPVIMVQAYRLLVAEMYVHGWDYPLHLGVTEAGEGEDGRMKSAIGIGTLLQDGLGDTIRVSLTEPPEEEIDPCRRLANLGTKAAKLQQGVAPFEEKHRHYFDFQRRTGDLPVQKEGEEVDYRNVLHRDGSVLMSISLDQLKAPELLYRSLATKLVVGMPFKDLATVDSILLRELPPVDDQVARLALKRLIDVSMGVIAPLSEQLTKPLPNAMVLVNLKELSGGAYKLLPEGTRLVVSLRGDEPYEELEILKNIDATMILHDVPFTEDKVSRVHAARRLFEFLSENSVNFPVIHHINFPTGIHRDELVIHAGTYAGGLLVDGLGDGVMLEAPDQDFDFLRNTSFNLLQGCRMRNTKTEYVSCPSCGRTLFDLQEISAEIREKTSHLPGVSIAIMGCIVNGPGEMADADFGYVGGSPGKIDLYVGKTVVKRGIAMTEATDALIGLIKEHGRWVDPPVADEX

SEQ ID NO: 10513 - protein, 532 aa, Arabidopsis thaliana; identical to SEQ ID NO: 10512
  misc_feature (532)..(532): Xaa can be any naturally occurring amino acid
  unsure (1)..(532): unsure at all Xaa locations

SEQ ID NO: 10514 - protein, 722 aa, Arabidopsis thaliana
  misc_feature (722)..(722): Xaa can be any naturally occurring amino acid
  unsure (1)..(722): unsure at all Xaa locations
KVPPMASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALFX

SEQ ID NO: 10515 - protein, 594 aa, Glycine max
  misc_feature (594)..(594): Xaa can be any naturally occurring amino acid
  unsure (1)..(594): unsure at all Xaa locations
MDVRRRPIPPSGDRRQTQKLKNTATTDSQTLLPLYLTNALFFAVFFSVAYFLLHRWREKIRTATPLHAVTPAETAAIVSLVASAVYLLGFFGVASRASLDELSDDEIILKEDSRAPGPCAAALSDSCSLPNNKIQDQFPLPPRAVHSLAKEKQHIPSPPQVDSPVSVSVSVSSSSDDEDEEIVQAVVSGSIPSYSLESRLGDTRRAATIRHEVVQRLTSRSLSGLPLEGFNYDSILGQCCEMPIGFVQIPVGVAGPLLLDGKEFTVPMATTEGCLVASTNRGCKAIYVSGGASSVLLRDGMTRAPVVRFPSAQRAAQLKFFLEDPLNFDSLAVVFNKSSRFARLQNIQCAIAGKNLYMRFRCSTGDAMGMNMVSKGVQNVLDFLQSDFPDMDVIGISGNFCSDKKAAAVNWIEGRGKSVVCEAIIKEDVVKKVLKTSVEAMVKLNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQX

SEQ ID NO: 10516 - protein, 368 aa, Glycine max
  misc_feature (368)..(368): Xaa can be any naturally occurring amino acid
  unsure (1)..(368): unsure at all Xaa locations
NPPFLNKNKKIKKNPSISWTSMTSLSTHHTYSRKQKSLGLLCTNFLSLYNKEGVRLVGLDDAASRLGVERRRIYDIVNVLESVGVLTRKAKNQYTWKGFCAIPAALQELKDEGLKENPGSFDDSNDNAKVSDDEEEEEETFPNINIGSQSEKENPDYTATVKSSKNENRREKSLALLTQNFVKLFVCSNFEMISLDEAAKLLLGNANNRTKVRRLYDIANVLSSMNLIEKTHTTNTRKPAFRWLGVRGKTWGGSVDLAQNSNVKESRKRMFGTDIGNISFKRNKVDLSMDGQNSKMQNQHENISPRAQLEKIIIKKDAKQTSESYQFGPFAPAYVPKVGTSENNSVKKVHDWDSLAQEHRPQYQNQGX

SEQ ID NO: 10517 - protein, 392 aa, Glycine max
  misc_feature (392)..(392): Xaa can be any naturally occurring amino acid
  unsure (1)..(392): unsure at all Xaa locations
QNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLLGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10518 - protein, 406 aa, Glycine max
  misc_feature (406)..(406): Xaa can be any naturally occurring amino acid
  unsure (1)..(406): unsure at all Xaa locations
VANPSSFNSSLATTAVLPLAAFFKSDFRELAMGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSFX

SEQ ID NO: 10519 - protein, 347 aa, Brassica napus
  misc_feature (347)..(347): Xaa can be any naturally occurring amino acid
  unsure (1)..(347): unsure at all Xaa locations
MKATLAPSSLISLPRHKVSSLRSPSLLLQSQRPSSALMTTTTASRGSVAVTAAATSSVEALREGIAEFYNETSGLWEEIWGDHMHHGFYDPDSSVQLSDSGHREAQIRMIEESLRFAGVTEEKKIKRVVDVGCGIGGSSRYIASKFGAECIGITLSPVQAKRANDLAAAQSLSHKVSFQVADALEQPFEDGIFDLVWSMESGEHMPDKAKFVKELVRVAAPGGRIIIVTWCHRNLSPGEEALQPWEQNLLDRICKTFYLPAWCSTSDYVDLLQSLSLQDIKCADWSENVAPFWPAVIRTALTWKGLVSLLRSGMKSIKGALTMPLMIEGYKKGVIKFGIITCQKPLX

SEQ ID NO: 10520 - protein, 470 aa, Glycine max
  misc_feature (470)..(470): Xaa can be any naturally occurring amino acid
  unsure (1)..(470): unsure at all Xaa locations
MQALHSPTLRASPLDPLRGPNNAAANRRSSSAKRVFFVSATVAPKVSAPQRQKDPKKRVVITGMGLASVFGNDVEGYYEKLLAGESGITAIDRFDASKFPTRFGGQIRGLSAEGYIDGKNDRRLDDCLRYCIVAGKKALENADLAPDNHSKIDKERAGVLVGSGMGGLTVFSDGVQALIEKGHRKITPFFIPYAITNMGSALLGIDLGFMGPNYSISTACATSNYCFYAAANHIRRGEADLMIAGGTEAAIIPIGLGGFVACRALSQRNDDPKTASRPWDKERDGFVMGEGAGVLVMESLEHAMKRGAPIIAEYLGGAVNCDAYHMTDPRSDGLGVSTCIQSSLEDAGVSPEEVNYINAHATSTLAGDLAEINAIKKVFKDTSGIKINATKSMIGHCLGAAGGLEAIATVKAITTGWLHPTINQFNPEPAVDFDTVANVKQQHEINVAISNSFGFGGHNSVVAFSAFKPX

SEQ ID NO: 10521 - protein, 284 aa, Glycine max
  misc_feature (284)..(284): Xaa can be any naturally occurring amino acid
  unsure (1)..(284): unsure at all Xaa locations
MEDPSAATTLLLNSEYSRLFVEDTDLYNRIVLGTLLPHFVWGPLPHFLQTWLRNYLGGVLLYLLSGLLWCFYIYYWKRNVYVPKDAIPSRRAMLLQISVAMKAMPWYTLLPTVSEYLVETGWTKCYPRLYNVGWLAYLVYLAIYLSIVEFGIYWMHRELHDIKPLYKYLHATHHIYNKQNTLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAMX

SEQ ID NO: 10522 - protein, 370 aa, Glycine max
  misc_feature (370)..(370): Xaa can be any naturally occurring amino acid
  unsure (1)..(370): unsure at all Xaa locations
LCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVRTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASVIKILTVKX

SEQ ID NO: 10523 - protein, 224 aa, Zea mays
  misc_feature (224)..(224): Xaa can be any naturally occurring amino acid
  unsure (1)..(224): unsure at all Xaa locations
MATPAVKVYGWAISPFVSRALLALEEAGVDYELVPMSRQDGDHRRPEHLARNPFGKVPVLEDGDLTLFESRAIARHVLRKHKPELLGGGRLEQTAMVDVWLEVEAHQLSPPAIAIVVECVFAPFLGRERNQAVVDENVEKLKKVLEVYEARLATCTYLAGDFLSLADLSPFTIMHCLMATEYAALVHALPHVSAWWQGLAARPAANKVAQFMPVGAGAPKEQEX

SEQ ID NO: 10524 - protein, 257 aa, Zea mays; identical to SEQ ID NO: 10038
  misc_feature (257)..(257): Xaa can be any naturally occurring amino acid
  unsure (1)..(257): unsure at all Xaa locations

SEQ ID NO: 10525 - protein, 234 aa, Zea mays
  misc_feature (234)..(234): Xaa can be any naturally occurring amino acid
  unsure (1)..(234): unsure at all Xaa locations
MAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQQQQLLPFSQLADVSPAAFLTQQQLLPFYLHAMPNAGTLLQLQQLLPFNQLALTNSTVFYQQPIIGGALFX

SEQ ID NO: 10526 - protein, 256 aa, Zea mays
  misc_feature (256)..(256): Xaa can be any naturally occurring amino acid
  unsure (1)..(256): unsure at all Xaa locations
PKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDEX

SEQ ID NO: 10527 - protein, 426 aa, Zea mays
MAPALSGTLGASSVAALRPCAGRRAPSAASSVAPRGSGVVRCSRGLRWDAHRSRGRLLRVRCDAAVAEKPAEEEAAGEKFEYQAEVSRLMDLIVHSLYSHKEVFLRELVSNASDALDKLRFLGVTDSSLLADGGELEIRIKPDLDAGTITITDTGVGMTKDELKDCLGTIAQSGTSKFLKALKENKDLGADNGLIGQFGVGFYSAFLVAEKVVVSTKSPKSDKQYVWEAVADSSSYVIKEETDPEKMLTRGTQITLFLRPDDKYEFADPSRIQGLVKNYSQFVSFPIYTWQEKSRTVEVEEDEEPKEVEEATKGEKKKKTITEKYWDWELANETKPIWMRNPKEIENTEYNEFYKKTFNEFLDPLAHTHFTTEGEVEFRSVLYVPGMAPLSNEEIMNPKTKNIRLYVKRVFISDDFDGELCAYCSF

SEQ ID NO: 10528 - protein, 320 aa, Zea mays
  misc_feature (320)..(320): Xaa can be any naturally occurring amino acid
  unsure (1)..(320): unsure at all Xaa locations
MAIKRTKAEKKIAYDKKLCSLLDEYTKVLIALADNVGSKQLQDIRRGLRGDSVVLMGKNTLIRRCIKVYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGEKVGSSESALLAKLGIRPFSYGLQVTSVYEDGSVFSPEVLDLSEEDLIEKFATGVSMVASLSLAISYPTLAAVPHMFINGYKNVLAVAVETDYSYPHADKIKEYLKDPSKFAVAAPVAAGDSGAAAAPKEEEKAAEPEEESDEEMGFSLFDDX

SEQ ID NO: 10529 - protein, 75 aa, Zea mays
LDLKQQRPRWHRVVVQGPGPWYGYVMALVGQRFLLTIGGNDGKRPPADVWALDTAAKPYEWRKLEPEGEGPPPCI

SEQ ID NO: 10530 - protein, 332 aa, Zea mays
  misc_feature (332)..(332): Xaa can be any naturally occurring amino acid
  unsure (1)..(332): unsure at all Xaa locations
SQRVSCSPQAPLPRFPSTPGANPNPTVARPAASANGAPRVSVRERGVDLEAATRGGEREMYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQDIDGAYFGTTFPHLFLMTYEHLKPQKLSQRYVPRVFGFKLHKPX

SEQ ID NO: 10531 - protein, 474 aa, Zea mays
  misc_feature (474)..(474): Xaa can be any naturally occurring amino acid
  unsure (1)..(474): unsure at all Xaa locations
MAGEEAAEGSGTRRHMDLNLYLGLPPLPRPPVWLDPTLMPNLTGAAPESSITGEPEESLALGAAAYSPSNALSTPEEHPMLDPIVYSWLDGNRTDGEEDTDAPEPGPVDGANVSRSQLVVAATGLEGDDDLPLVRFVRPSQMVVAGGMETVNTSILQQSIQRAAAIEARTPELRFQRVIQISQQHRIVRPASVNRSQGAASTDADRLVWAIQRTHNSLEATRRQKLDDNNLCGNGSAKKDESCDCNSSFECNICLDPAKQPVVTPCGHLFCWPCLYQWLHAHSPHSECPVCKGEVLELNVTPIYGRGGEEGNSTNPDFPPRPRANRRESLRQQLQMTDTRGIATVVRQLIQNQGIISVLPSPTGIEMSVVPAGRQRARARRQQRQDNNASSSIHVVAQNMGNVAPESSNQIQLSHSNGDNAAQMVLAAPQQSSSVEQLSTSSTTAVILGEPGSSRRSRPSESPTIRRTRRRPQX

SEQ ID NO: 10532 - protein, 496 aa, Zea mays; identical to SEQ ID NO: 4917

SEQ ID NO: 10533 - protein, 701 aa, Zea mays
  misc_feature (701)..(701): Xaa can be any naturally occurring amino acid
  unsure (1)..(701): unsure at all Xaa locations
MSVSPSSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVPVPMPARRRGDQMVPTMTTSSLNRAGTEVSADLVVANSEEEDTRAQVPFHAHLHPRAEAPPAARRTNNGARQHDVFQQPRNHRREALLAPSASEASSSWTGREGAVVPVWSPPAASGHSDAFAADEADVSSRSYLGRHPQSHRLMNWSQLSQSSX

SEQ ID NO: 10534 - protein, 383 aa, Zea mays
  misc_feature (383)..(383): Xaa can be any naturally occurring amino acid
  unsure (1)..(383): unsure at all Xaa locations
MKVERDLHMSRGDGEDSYASNSRLQEKSILKTRPVLHKAVAAAHALSLSSGGPGGGAMVVADLGCSSGPNTLLVVSEVLAAVAMVAGGSAQPQHVQFFLNDLPGNDFNLVFRSLDLLKNKKLAAKDRREESLLPPYYVAGLPGSFYTRLFPDHCVHLFHSSYCLMWRSKVPDELAGGAVLNEGHMYIWETTPQAVVALYRRQFQEDMSLFLRLRHRELVPGGHMVLAFLGRKKSKDVLRGEVSYTWGLLAQALQSLVKQGRVKKDKLDSFNLPFYAPSMDEVRDVITRSQAFDITHIQLFESNWDPHDDDDVEMKMEEDVAAVQSGVNVARSIRAVIGPLIARHFGEHILDDLFELHAKNVAVHLQKVKTKYPVIVVSLQAKX

SEQ ID NO: 10535 - protein, 294 aa, Zea mays
  misc_feature (294)..(294): Xaa can be any naturally occurring amino acid
  unsure (1)..(294): unsure at all Xaa locations
MGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTRTTSRPADLSGSSSPSTDSSDNNIX

SEQ ID NO: 10536 - protein, 582 aa, Zea mays
  misc_feature (582)..(582): Xaa can be any naturally occurring amino acid
  unsure (1)..(582): unsure at all Xaa locations
MADEAKAKGNAAFSAGRFEEAARHFTDAIALAPGNHVLYSNRSAALASLHRYSDALADAQKTVELKPDWAKGYSRLGAAHLGLGDAASAVAAYEKGLALDPSNEGLKAGLEDAKKAAAAPPRRGPSGPDAIGQMFQGPELWSKIASDPTTRAYLNEPDFMQMLREVQRNPSSISMYLSDPRMMQVLSLMLNVKIQRPEASEPSQSTPPPPPQQQQQQTSPLQTKAREVEPEPEPEPMDFTDEEKERKERKAAAQKEKELGNTAYKKKDFEAAIQHYTKALELDDEDISYLTNRAAVYIEMGKYDECIKDCDKAVERGRELRADFKMISRALTRKGTALVKLAKTSKDFDIAIETYQKALTEHRNPDTLKKLNEAERAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAMETYQAGLKHDPKNQELLDGVRRCIEQINKANRGEISQDELQERQNKAMQDPEIQNILTDPIMRQVLNDFQENPRAAQEHLKNPGVMQKIQKLVSAGIVQMRX

SEQ ID NO: 10537 - protein, 213 aa, Zea mays
  misc_feature (213)..(213): Xaa can be any naturally occurring amino acid
  unsure (1)..(213): unsure at all Xaa locations
PLPLPLPAAATYAQVLSAHRSAPASSHARTAHRYLFSPLPSHSPGQSRPGMASPSSSPSRKALSKIACSRLQKELAEWQVNPPAGFKHRVTDDLQRWVIDVAGAAGTLYTGETYKLQVDFPEHYPMEAPQVIFLHPAPMHPHIYSNGHICLDILYDSWSPAMTVSSICISILSMLSSSPEKQRPADNDRYVKNCRNGRSPKETRWWFHDDTVX

SEQ ID NO: 10538 - protein, 632 aa, Glycine max
  misc_feature (632)..(632): Xaa can be any naturally occurring amino acid
  unsure (1)..(632): unsure at all Xaa locations
YTVLKNLRYTMMRARFPLLLLGVVFLASVSVSFGIAYWEKQNPSHNKCLRSCNSEKDSYRNQACHARCNLLKVEEEEECEEGQIPRPRPQHPERERQQHGEKEEDEGEQPRPFPFPRPRQPHQEEEHEQKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10539 - protein, 504 aa, Glycine max
  misc_feature (504)..(504): Xaa can be any naturally occurring amino acid
  unsure (1)..(504): unsure at all Xaa locations
QKEEHEWHRKEEKHGGKGSEEEQDEREHPRPHQPHQKEEEKHEWQHKQEKHQGKESEEEEEDQDEDEEQDKESQESEGSESQREPRRHKNKNPFHFNSKRFQTLFKNQYGHVRVLQRFNKRSQQLQNLRDYRILEFNSKPNTLLLPHHADADYLIVILNGTAILTLVNNDDRDSYNLQSGDALRVPAGTTYYVVNPDNDENLRMITLAIPVNKPGRFESFFLSSTQAQQSYLQGFSKNILEASYDTKFEEINKVLFGREEGQQQGEERLQESVIVEISKKQIRELSKHAKSSSRKTISSEDKPFNLRSRDPIYSNKLGKLFEITPEKNPQLRDLDVFLSVVDMNEGALFLPHFNSKAIVVLVINEGEANIELVGIKEQQQRQQQEEQPLEVRKYRAELSEQDIFVIPAGYPVVVNATSDLNFFAFGINAENNQRNFLAGSKDNVISQIPSQVQELAFPGSAKDIENLIKSQSESYFVDAQPQQKEEGNKGRKGPLSSILRAFYX

SEQ ID NO: 10540 - protein, 282 aa, Zea mays
  misc_feature (282)..(282): Xaa can be any naturally occurring amino acid
  unsure (1)..(282): unsure at all Xaa locations
RSKSSPAPAAPKSGNPLLRMDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEGEHGETLCGACKESYGPDEFWICCDLCEKWFHGKCVKITAAKAEHIKQYKCPSCTGGGGVSNSGTKRARPSX

SEQ ID NO: 10541 - protein, 380 aa, Zea mays; identical to SEQ ID NO: 10029
  misc_feature (380)..(380): Xaa can be any naturally occurring amino acid
  unsure (1)..(380): unsure at all Xaa locations

SEQ ID NO: 10542 - protein, 400 aa, Zea mays
  misc_feature (400)..(400): Xaa can be any naturally occurring amino acid
  unsure (1)..(400): unsure at all Xaa locations
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGCFPGGGMPGGFPGGGMPGGFPGGVPGNVDMSKILNDPDLMAAFSDPEVMAALQDVMNNPANFAKHQANPKVGPIIAKMMAKFNGSQX

SEQ ID NO: 10543 - protein, 512 aa, Glycine max
  misc_feature (512)..(512): Xaa can be any naturally occurring amino acid
  unsure (1)..(512): unsure at all Xaa locations
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVKX

SEQ ID NO: 10544 - protein, 342 aa, Glycine max; identical to SEQ ID NO: 10374
  misc_feature (342)..(342): Xaa can be any naturally occurring amino acid
  unsure (1)..(342): unsure at all Xaa locations

SEQ ID NO: 10545 - protein, 227 aa, Zea mays; identical to SEQ ID NO: 9908

SEQ ID NO: 10546 - protein, 380 aa, Zea mays
  misc_feature (380)..(380): Xaa can be any naturally occurring amino acid
  unsure (1)..(380): unsure at all Xaa locations
MGAELGEAGVPARDMVDALEGVRSILLKPSERLDDKRFTRIAGADFDDAGLGLAGLLGSLASTGFQASNLGDAIDVVNQMLDWRLSHEKPSDDCAEAELDPAYRESVKCKIFLGFTSNLVSSGVREIIRFLVQHRMVDVVVTTAGGIEEDLIKCLAPTYRGDFTLPGALLRSRGLNRIGNLLVPNDNYCKFEHWIMPILDKMLLEQSTQNVWTPSKVIARLGKEINDESSYLYWAYKNNIPVFCPALTDGSIGDMLFCHSVHSPGLVVDIVQDVRLMNAETIHASPRKTGIILLGGGLPKHHICNANMLRDGADYAVYVNTAQEFDGSDSGARPDEAVSWGKIKSSARTVKVHCDATIAFPLLVAATFARKVHGTKSTNX

SEQ ID NO: 10547 - protein, 299 aa, Zea mays
  misc_feature (299)..(299): Xaa can be any naturally occurring amino acid
  unsure (1)..(299): unsure at all Xaa locations
MARYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWETENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFNX

SEQ ID NO: 10548 - protein, 389 aa, Zea mays; identical to SEQ ID NO: 10019
  misc_feature (389)..(389): Xaa can be any naturally occurring amino acid
  unsure (1)..(389): unsure at all Xaa locations

SEQ ID NO: 10549 - protein, 360 aa, Zea mays; identical to SEQ ID NO: 10404

SEQ ID NO: 10550 - protein, 405 aa, Oryza sativa
  misc_feature (405)..(405): Xaa can be any naturally occurring amino acid
  unsure (1)..(405): unsure at all Xaa locations
MKLHFVLRFLFGPVPVYFSALAILILLTNAQYFGLVGVTVPRATKLASSAPVVSVMKYCDIFRGEWVPDSDAPYYNHKTCYMIQEHQNCLKYGRPDLEFLKWRWRPSGCELPRFDPVQFLQFNRHKSLAFVGDSLARNHMQSLLCLLSQVAYPKDMSANPTTQNKVYHYRGYNFTVSMFWSPFLVKAREPDHDGPAHTGHWSLYLDEPDQSWVSEISRFDYVLVSAANWFSRPSLFYEKRRLVGCSFCSRQYGVPDLTLYYSQRRAWRVALKAINDLESLRGRVIVRMLSPMSHFENGTWDQGGNCKRTQPLRSNETVMEGRDLHFYTAQMEEYRAAEKVAEAKGRRMMLMDATAAMLMRPDGHPSRYGHLPNQKVQLYNDCIHWCLPGPIDIWNDMLFQMLLVX

SEQ ID NO: 10551 - protein, 582 aa, Oryza sativa
  misc_feature (582)..(582): Xaa can be any naturally occurring amino acid
  unsure (1)..(582): unsure at all Xaa locations
MTICSCEETINEFEMLTRDAARVQKDTLKKILEINASAEYLQNFGLGGRTDAESYKSCIPLCVHNDIEPYIQRIVDGDTSPVVTGEPITNLSLSSGTTHGKPKFIPFNDELLETTLQIYRTSYAFRNREYPIGQGKALQFVYGSKQVITKGGILATTATTNLYRRQRYKEGMKDIQSQCCSPDEVIFGPDFHQSLYCHLLCGLIYSEEVHSVFSTFAHSLVHAFQTFEEVWEDLCTDIRDGVLSKKVTAPSIREAVSKILKPNPELADSIYKKCIGLSNWYGVIPALWPNAKYVYGIMTGSMEPYLKKLRHYAGNLPLISADYGASEGWVGSNIDPTVPPEQVTYAVLPQVGYFEFIPLEKPIGEETENSASIHYIESDPVGLTEVEVGKIYEVVITNFAGLYRYRLGDVVKIARFHNSTPELQFICRRSLVLSINIDKNTEKDLQLAVEEASKFLEGEKLEVMDFTSFVERSSDPGRYVIFWELSGDASDEVLSSCANALDLAFIDAGYTGSRKIKTIGPLELRILRKGTFKEILDHFLSLGGAVSQFKTPRFVNPSNSKVLQILSRNVTQSYFSTAYGFX

SEQ ID NO: 10552 - protein, 596 aa, Oryza sativa
  misc_feature (596)..(596): Xaa can be any naturally occurring amino acid
  unsure (1)..(596): unsure at all Xaa locations
MGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSERALSLAVLQMPSLRYIWVQGYRASQTGLDLLLMARPFWNIEFTPPSPESFNHMTEDGEPCVDSHAQVLAYYSLAGRRSDCPQWVIPLHPAX

SEQ ID NO: 10553 - protein, 102 aa, Oryza sativa; identical to SEQ ID NO: 6789

SEQ ID NO: 10554 - protein, 336 aa, Zea mays
  misc_feature (336)..(336): Xaa can be any naturally occurring amino acid
  unsure (1)..(336): unsure at all Xaa locations
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSPX

SEQ ID NO: 10555 - protein, 338 aa, Zea mays
VQVVQETVVPVPSEEDKEAEAALVHKISSLAAAIAKLPSLSPSPEVNALFTELVTACIPRSSVDVELLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPGEIRRGGFDVLAVHHPEGEVINSVIIARKPVAVDAHATGGVGHAHAHGAVLNRPCLCCEMEARAHQKMEEVAVEQLPS

SEQ ID NO: 10556 - protein, 492 aa, Zea mays
  misc_feature (492)..(492): Xaa can be any naturally occurring amino acid
  unsure (1)..(492): unsure at all Xaa locations
PAAPRHTSPLHSYPSPLLYRRPPPSGRRSVSLSAQRAEHRRFRDTMMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLRX

SEQ ID NO: 10557 - protein, 370 aa, Zea mays
  misc_feature (370)..(370): Xaa can be any naturally occurring amino acid
  unsure (1)..(370): unsure at all Xaa locations
SPSPQTQASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 10558 - protein, 226 aa, Zea mays
  misc_feature (226)..(226): Xaa can be any naturally occurring amino acid
  unsure (1)..(226): unsure at all Xaa locations
TVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 10559 - protein, 504 aa, Zea mays
  misc_feature (504)..(504): Xaa can be any naturally occurring amino acid
  unsure (1)..(504): unsure at all Xaa locations
FHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10560 - protein, 196 aa, Zea mays
  misc_feature (196)..(196): Xaa can be any naturally occurring amino acid
  unsure (1)..(196): unsure at all Xaa locations
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQKAAEAGQYAKDTAVSGKDKSGGVIQQATEQVKSAAAGAKDAVMSTLGMGGDDKQGDANTNTNKDSSTITRDHX

SEQ ID NO: 10561 - protein, 250 aa, Zea mays; identical to SEQ ID NO: 10408
  misc_feature (250)..(250): Xaa can be any naturally occurring amino acid
  unsure (1)..(250): unsure at all Xaa locations

SEQ ID NO: 10562 - protein, 165 aa, Zea mays; identical to SEQ ID NO: 6144

SEQ ID NO: 10563 - protein, 369 aa, Zea mays
  misc_feature (369)..(369): Xaa can be any naturally occurring amino acid
  unsure (1)..(369): unsure at all Xaa locations
RPLSHKASDLSRLRRRFVRVEGRRQEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 10564 - protein, 913 aa, Zea mays; identical to SEQ ID NO: 10238
  misc_feature (913)..(913): Xaa can be any naturally occurring amino acid
  unsure (1)..(913): unsure at all Xaa locations

SEQ ID NO: 10565 - protein, 593 aa, Zea mays
  misc_feature (593)..(593): Xaa can be any naturally occurring amino acid
  unsure (1)..(593): unsure at all Xaa locations
RSSRASMGSYAYKYCMCFTRKFRSPDAQPPPDVRAAHLSFASDAHALRRFVAGVQGESPADVDRILAMLSGGHSHGIARLVTRSPAASTPTLEDFLAFLFSPDLNPPIAHQVHQDMSAPFSHYFVFTGHNSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDSDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFVX

SEQ ID NO: 10566 - protein, 260 aa, Zea mays
  misc_feature (260)..(260): Xaa can be any naturally occurring amino acid
  unsure (1)..(260): unsure at all Xaa locations
SAELSREENVYMVKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQX

SEQ ID NO: 10567 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 10568 - protein, 206 aa, Zea mays
  misc_feature (206)..(206): Xaa can be any naturally occurring amino acid
  unsure (1)..(206): unsure at all Xaa locations
MRTICDVCESAPAVLFCAADEAALCRPCDEKVHMCNKLASRHVRVGLADPNKLARCDICENSPAFFYCEIDGTSLCLSCDMTVHVGGKRTHGRYLLLRQRVEFPGDKPGHMDDVPMEIKDPENQREQNTPKEQMANHHNVNDPVSDGNCDGQGNIDSKMIDLNMRPARTHGQGSNSQTQGVDLSVNNHDSPGVVPTSNSERDAIKX

SEQ ID NO: 10569 - protein, 670 aa, Zea mays
MALPSMSLAAKGVLPFSARTSSGVTQRPVSVTASLEHKTSDARRKFLKLALGNLGVGLPTLLGAKKALADEQGVSSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGSNKKFDSDVSLDVIAMRTPGFSGADLANLLNEAAILAGRRGRTAISSKEIDDSIDRIVAGMEGTVMTDGKSKSLVAYHEVGHAICGTLTPGHDPVQKVTLVPRGQARGLTWFIPMDDPTLISRQQLFARIVGGLGGRAAEEVIFGEPEVTTGAAGDLQQITGLAKQMVVTFGMSEIGPWSLMEGGAQSGDVIMRMMARNSMSEKLAEDIDSAVKQLSDEAYEIALRHIRNNREAIDKIVEVLIEKETVTGDEFRAILSEFAEIPVENRVPPAT

SEQ ID NO: 10570 - protein, 329 aa, Zea mays
  misc_feature (329)..(329): Xaa can be any naturally occurring amino acid
  unsure (1)..(329): unsure at all Xaa locations
NNPASSKKGYEYEPQSRAGGGRANSKASRSSPIRLSPNLIAGFRQKGRDAARFRRGLFCPFRAILLSAREASTDGSEGEGGGGGPRRWKWNAPMRKFQDSIKALQADIDHANAMASEFLRDYDGSVIQMRVAYSAVAHFLLQWTDCKLAGALGLLKVMLYKVCADGSSALPDWEMEASIREFYGVIFPSLLQLPSGITELDDRKQRKLCLKKFRSRDEQLSEVDTERELECGICLEVSPKVVLPDCAHMLCMRCFEDWNAKSKSCPFCRACLEEVKPGSLWIYTDGSDVVDMDTLTRENIRRLFMYINKLPLVVLHVVDLDVYKYRIKX

SEQ ID NO: 10571 - protein, 568 aa, Zea mays
  misc_feature (568)..(568): Xaa can be any naturally occurring amino acid
  unsure (1)..(568): unsure at all Xaa locations
MSGASNYGSLIDEWLPPPTPSPRTLMSSFLNEEFSSAPFSGPHDQSEKSREVLNSSDEVPSHAVKGLFQNGFSNLFSAKSNSNGGLAERRAARAGFSVPKIDTSRVGSSTVIRSPVSIPPGLSPTTLLESPVFLYNKMAQPSPTTGTLPFLMATNDKSTISPAAKITEDSTFDNDVFSFQPHLGSEQTGFSTAEKDYGAYEKKQSLSNIHQQESSLQSSFTAVKDNTSATIVKAKPSSSSMFSDSHYSADQQQADETNIKVQGKGVEARSAAFAPVSAHSDASLLESQEALDVSSTLSNEEDERATHGTVSIECDGDEAETVSKRRKLELDALEATLTATTSTTSTIDMGPAASRAVREPRVVVQTTSEVDILDDGYRWRKYGQKVVKGNPNPRSYYKCTNPGCSVRKHVERASHDLKSVITTYEGKHNHEVPAARNSGQGSSSAPSASQAGGSHRRQEPAQASFAHFGTASFSSFGLPPSGQLGPTTGNFGFGMVPPGMTIPVPSLGSLAPVKMVGNSSAMQGYPGLMVPGEPKVEPVSQPLIQMANASPPAYQQILSRPPFGHQMX

SEQ ID NO: 10572 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10573 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10574 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10575 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10576 - protein, 234 aa, Zea mays
  misc_feature (234)..(234): Xaa can be any naturally occurring amino acid
  unsure (1)..(234): unsure at all Xaa locations
MAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPVAFLTQQQLLPFYLHAAPNAGTLLQLQQLLPFNQLALTNPTTFYQQPIIGGALFX

SEQ ID NO: 10577 - protein, 508 aa, Zea mays
  misc_feature (508)..(508): Xaa can be any naturally occurring amino acid
  unsure (1)..(508): unsure at all Xaa locations
SKPSYFPAMTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDDX

SEQ ID NO: 10578 - protein, 164 aa, Zea mays
  misc_feature (164)..(164): Xaa can be any naturally occurring amino acid
  unsure (1)..(164): unsure at all Xaa locations
GFVGERIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRNX

SEQ ID NO: 10579 - protein, 501 aa, Zea mays
  misc_feature (501)..(501): Xaa can be any naturally occurring amino acid
  unsure (1)..(501): unsure at all Xaa locations
PISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10580 - protein, 554 aa, Zea mays
  misc_feature (554)..(554): Xaa can be any naturally occurring amino acid
  unsure (1)..(554): unsure at all Xaa locations
RGSAGCKKLSLPPSPVLLLARCLRRRDRDTMAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIVGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADAX

SEQ ID NO: 10581 - protein, 382 aa, Zea mays
  misc_feature (382)..(382): Xaa can be any naturally occurring amino acid
  unsure (1)..(382): unsure at all Xaa locations
SACRLQPMRIERDLHMATGDGETSYTKNSRIQEKTMFQIKPVLEEATRAVYTALHPQTMVVADLGCSSGPNTLRFVSEVIGIIARHCKEYGRQHDHTQLQFFLNDLPGNDFNNLFQLIQQFNKSTAINHKSEAVEALPPPCYISGLPGSYYTRIFPSESVHLFHSLFCLQWRSEAPEGNKKTCLDIYITKTMSPSMVKLFQQQFQKDFSLFLRLRYEELVSGGQMVLTFIGRKHENVFTGESNHLYGLLAQSLKSLVDEGLVEKEKLESFYLPMYSPSVGEVEAILKQVGLFNMNHVKVFQTNWDPYDDLESDVVHNSIRSGENVAKCLRAVMQPLVASQFGEPILDKLFKEYARRVAKHLENEKTKHAIIVLSIEKAIHLX

SEQ ID NO: 10582 - protein, 727 aa, Zea mays
  misc_feature (727)..(727): Xaa can be any naturally occurring amino acid
  unsure (1)..(727): unsure at all Xaa locations
AIPRSRGSCASGDQRSCSSSPPGAAVPASQPAAAAAAAVSELELLVPRGRGAGAMDQLRPEPAAGAHEIEKTAAPDVESEPAAAVPEPERVPPWREQVTARGMVAALLIGFVYTVIVMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKVALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGSX

SEQ ID NO: 10583 - protein, 280 aa, Zea mays
  misc_feature (280)..(280): Xaa can be any naturally occurring amino acid
  unsure (1)..(280): unsure at all Xaa locations
RSSTPAPAAAASSLAHLLLCGSVRRRSRMASAAGGGAAGEGEWLKVSQLRPMVEAQDPNAKAVDNLTLRRFLRARDHDVDKASAMFLKFLKWRREAAPGGSVPEEQVRRELSQDKLCMGGVDRAGRPILVAFAARHFSAGRDMAEFKSFVVYFFDKICARIPRGQEKFLCIVDLKGWGYSNCDVRAYIAAIEILQNYYPERLGKALMIHVPYIFMKAWKMIYPFIDTNTRDKFVFVEDKSLQETLRREIDEGQLPEFLGGKMDVIPLKDYGVQQQPQAVX

SEQ ID NO: 10584 - protein, 383 aa, Zea mays
  misc_feature (383)..(383): Xaa can be any naturally occurring amino acid
  unsure (1)..(383): unsure at all Xaa locations
ASACRLQPMRIERDLHMATGDGETSYTKNSRIQEKTMFQIKPVLEEATRAVYTALHPQTMVVADLGCSSGPNTLRFVSEVIGIIARHCKEHGRQHDHPQLQFFLNDLPGNDFNNLFQLIQQFNKPTAINHKSEAAEALPPPCYISGLPGSYYTRIFPSESVHLFHSLFCLQWRSEAPEGNKKTCLDIYITKTMSPSMVKLFQQQFQKDFSLFLRLRYEELVSGGQMVLTFIGRKHEDVFTGESNHLYGLLAQSLKSLVDEGLVEKEKLESFYLPMYSPSVGEVEAILKQVGLFNMNHVKVFQTNWDPYDDLESDVVHNSIRSGENVAKCLRAVMQPLVASQFGEPILDKLFKDYARRVAKHLENEKTKHAIIVLSIEKAIHLX

SEQ ID NO: 10585 - protein, 507 aa, Zea mays
  misc_feature (507)..(507): Xaa can be any naturally occurring amino acid
  unsure (1)..(507): unsure at all Xaa locations
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNILFVLGFNAFGGFSVFLPFLVAKVGGAPALRERLRDEVRRAMVGKDGDGDGEFGFATVREGMPLVRSTVYEMLRMQPPVPLQFGRARRDFVLRSHGGAAYQVTAGEVLCGYQPLAMRDPEVFERPEEFVPERFLGDEGARLLQHLFWSNGPETAQPGPGNKQCAAKEVVVDTACMLLAELFRRYDDFEVEGTSFTKLVKRQASPSVAQAAAAAGAQQX

SEQ ID NO: 10586 - protein, 449 aa, Zea mays
  misc_feature (449)..(449): Xaa can be any naturally occurring amino acid
  unsure (1)..(449): unsure at all Xaa locations
MPFRSIVRDVRDGFGSLSRRGFEVRFLSHRRGKSHGAVHELHDPVLVVQSSCWASLPPELLRDVIERLETSEDTWPSRKHVVACAAVCRTWREMCREIVKSPEFSGKITFPVSLKQPGPRDGTIQCFIKRDKSTQIYSLYLSFSSAVPVENGKFLLSAKRNCRATYTEYIISINSGDTSRCTSNNTYIGKLRSNFLGTKFVIYDTHPPYNGTSQTVAGKTSQRFYSKKGSTKVSCRWYSIAQISYELNVLGTRGPRRMNCVMHSIPASCLEAGGSVPCQPDSIAAHSVGGSFSSVSLSKSSTMDHSMHFTSSRLSDAITGDGIVNRGQALNDADDEECKDMPLILRNKAPRWHEQLQCWCLNFRGRVTVASVKNFQLVAATQPAAGALTPSQAAPQPAPPPPPDQEKVILQFGKVGKDIFTMDYCYPLSAFQAFAICLSSFDTKLACEX

SEQ ID NO: 10587 - protein, 259 aa, Zea mays
MKVERDLHMSRGDGEDSYASNSRLQEKSILKTRPVLHKAVAAAHALSLSSGGPGGGAMVVADLGCSSGPNTLLVVSEVLAAVAMVAGGSAQPQHVQFFLNDLPGNDFNLVFRSLDLLKNKKLAAKDRREESLLPPYYVAGLPGSFYTRLFPDHCVHLFHSSYCLMWRSKVPDELAGGAVLNEGHMYIWETTPQAVVALYRRQFQEDMSLFLRLRHRELVPGGHMVLAFLGRKKSKDVLRGEVSYTWGLLAQALQSLVKQ

SEQ ID NO: 10588 - protein, 752 aa, Zea mays
  misc_feature (752)..(752): Xaa can be any naturally occurring amino acid
  unsure (1)..(752): unsure at all Xaa locations
HQLQTSEKRRVGGKLLLYDSCAHSSTVLGNLGGEEEESSGSQRTTHYSWLHGFLTSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVHVPMPARRRGDQMVPTMTTSSLNRAGTEVSADLVVANSEEEDTRAQVPFHAHLHLHPRAEAPPAARRTNNGARQHDVFQQRRNHRRDALLAPSASEASSSWTGREGAVVPVWSPPAASGHSDAFAADEADVSSRSYLGRHPQSHRLMNWSQLSQSSX

SEQ ID NO: 10589 - protein, 481 aa, Zea mays; identical to SEQ ID NO: 9905
  misc_feature (481)..(481): Xaa can be any naturally occurring amino acid
  unsure (1)..(481): unsure at all Xaa locations

SEQ ID NO: 10590 - protein, 452 aa, Zea mays
  misc_feature (94)..(94): Xaa can be any naturally occurring amino acid
  misc_feature (146)..(146): Xaa can be any naturally occurring amino acid
  misc_feature (152)..(152): Xaa can be any naturally occurring amino acid
  misc_feature (158)..(158): Xaa can be any naturally occurring amino acid
  misc_feature (186)..(186): Xaa can be any naturally occurring amino acid
  misc_feature (337)..(337): Xaa can be any naturally occurring amino acid
  misc_feature (357)..(358): Xaa can be any naturally occurring amino acid
  misc_feature (363)..(363): Xaa can be any naturally occurring amino acid
  misc_feature (376)..(376): Xaa can be any naturally occurring amino acid
  misc_feature (389)..(389): Xaa can be any naturally occurring amino acid
  misc_feature (434)..(434): Xaa can be any naturally occurring amino acid
  misc_feature (446)..(447): Xaa can be any naturally occurring amino acid
  unsure (1)..(452): unsure at all Xaa locations
REEEEAREASLTYGRRPWGRRRRRTTPPRRTRGARGRRPSTTGSRSPRRGTPSGGTPPSTMSPPWSAPACSACPTPCPSLAGALASRCWWCRGXSRCTRCGRWWRCTRWSPGSGSTVTTSWGSTRSGTGWACGSWCRSSWSSRWAXTSCTWXPAASPXRSSTTCWCAATRGCARGRTTSRPPTSSXSSRPSTSSSRSSPTSTPSPASPSPPPSCRSATPPSRGARRCTRGGCRASTTTCARPPRRGRCSASSARWGTWRSPTPATTWCWRSRPPSRPPPTSRPRSPCGRAWWSPTSWWRSATSPSRSSATGRSETRSRTTSSSRSASPSGSSRSPTXWSSSMSSAATRSMPCRCLTXXRPCWXRSCASLPASRCVXSLGPSMLRSRCSXPSPSPSSVGCSVSSAGSPSRRPPISFPASCGSQSTSPRGSASPGXPTGCASFLGCSXXFCRPS

SEQ ID NO: 10591 - protein, 628 aa, Zea mays
  misc_feature (628)..(628): Xaa can be any naturally occurring amino acid
  unsure (1)..(628): unsure at all Xaa locations
GDSKNLHAHARPRSPASRPRAVADSLSDPDPMGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVTDEDIAVLVRARGHMLQVLKLDKCSGFSTDALRLVARSCRSLRTLFLEECIIADEGSEWLHELAVNNSVLVTLNFYMTELKVEPADLELLARNCKSLISLKMSDCDLSDLIGFLQTSKALQEFAGGAFFEVGEYTKYEKVKLPPRLCFLGGLTFMGKNEMPVIFPYSASLKKLDLQYTFLTTEDHCQLIAKCPNLLVLEVRNVIGDRGLEVVADTCKKLRRLRIERGDDDPGQEEQGGVSQIGLTAVAVGCRELEYIAAYVSDITNGALESIGTFCKNMYDFRLVLLDKQNKITDLPLDNGVRALLRSCTKLRRFALYLRPGGLSDAGLGYVGQYSGNIQYMLLGNVGESDNGLIRFAMGCANLRKLELRGCCFSERALAVAVLQMPSLRYVWVQGYRASQTGRDLMLMARPYWNIEFVPPRPESACRVMADGQPCVDTHAQVLAYYSLAGRRPDCPRWLVTLHPAX

SEQ ID NO: 10592 - protein, 599 aa, Zea mays
  misc_feature (599)..(599): Xaa can be any naturally occurring amino acid
  unsure (1)..(599): unsure at all Xaa locations
ARAKRNTIVGNKIKEHHIDILSPPSHSIGFGGARGARATDDPRNEHRSVARKLHRVAGPGARGTAMAGAGAAANGGRNKYAVLDRSEERQTDARTERRRRPLAPESERGRRERFVYACAVFASLNAVLLGYDVGVMSGAIIYMQKDLHITEFQQEILVGCLSVVSLLGSLSGGRTSDAIGRKWTMGLGAIVFQIGATIMTFAPSFTVLMIGRLLAGVGIGFGAMVSGVYIAEISPAGARGTLTSLPEICINFGILLGYVSNYAFSGLSEHINWRIMLGVGILPSVFIGFALFVIPESPRWLMMEKRVSEARAVLLQISESEAEAEERLAEIEEAAGLMKSMKSEDKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQNHAVGLMSPRVGIDLAIFAVCGNVAFFSIGMGPICWVLSSEVFPLRLRAQGSALGQVGGRVSSGLVSMSFLSMARAISVAGMFFVFAAISTISVLFVYFCVPETKGKTLEQIEMMFESGDEWGGGEIELEDTQHLIPSIKKSVPLGX

SEQ ID NO: 10593 - protein, 721 aa, Zea mays
  misc_feature (721)..(721): Xaa can be any naturally occurring amino acid
  unsure (1)..(721): unsure at all Xaa locations
MEMNSSGEETVVKVRKPYTITKQRERWTEAEHKRFLEALKLYGRAWQRIEEHVGTKTAVQIRSHAQKFFTKLEKEAMNNGTSPGQAHDIDIPPPRPKRKPNSPYPRKSCLSSETQTKELPNDKSTKPNMPLSNGHVKMVGDASLQNFQRKELSEKGSRSEVLNLFRDAPSASFSSVNKSSSNHGAPRRTEASKTESRDMSIMENNSFNPNTQEDVKVISDQEMERLNGIQIRSKCEHSHEGYLDISTQQMKLMPKSVETTYVDEQTARASHTLAESNGTASVPVTVPEGTHPDQTSDQVGINGSMNPCIHPMVSADPKFGSSATPQTFPHNYAAFAPMMQCNCNQDTYRSFTNMSSTFSSMLVSTLLSNPAIHAAARLAASYWPAAEGNTPIDPNQENPADGVQGRNIGSPPSMASIVAATVAAASAWWATQGLLPFFAPPVAFPFVPAPSAAFPTVDVPRPSEKDRDCPVENAQNECQEARKQVQFEGLRVAASSESDGSGKGEVSLHTELKLSPAQNADATPTTGAGTNDAFRNKKKQDRSSCGSNTPSSSDVDAGNVPEEDNANEKAKQASCSNSSAGDTNHRRFRSNGSTSDSWKEVSEEGRLAFDALFSREKLPQSFSPPQAVDSKEVAKEEEDEVTTVAVDLNKNATSIDHDDLDTMDEPRASFPNELSHLKLKSRRTGFKPYKRCSVEAKENRVPTSDMVGTKRIRLDSEASTX

SEQ ID NO: 10594 - protein, 266 aa, Zea mays
ITMDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIARGA

SEQ ID NO: 10595 - protein, 559 aa, Zea mays
  misc_feature (559)..(559): Xaa can be any naturally occurring amino acid
  unsure (1)..(559): unsure at all Xaa locations
MHAVYELFERMAYYGISSNLIIYLTDKLHQGTVEASNNVTNWSGTVFLTPLLGAYVADAYLGRYWTFVVGSAIYLLGMVLLVLSVSVPALKPPPCGAGGVCPQASALQLGAYFGGLYIVALGNGGTKPNISTIGADQFDEFDPRERTHKLSFFNWWMFTIFLGILFSSTVLVYLQDNVSWSVGYGIPTLGLMVSISVFLAGTRLYRHRVPQGSPFTSMGRVLAAALWKWSVPVPADAKELHELDVEEYARKRRFRMDSTDAMAFLNKAAAVAVPSGGPASTPAWSLCTVTQVEETKQILRLVPLLVAMIVPCTLIAQTNTLFVKQGTTMDRHMGPRFEIPAASLGAFVTLTMLVAVVVYDRVFVRAVRRYTKDPRGITILRRMGTGMLLQVATMAVASAIESRRLAYARSHGLDATGGQLGLTIFALLPQFVLMGLADAFLVVGKIEFFYDQAPESMKSLGTAMSLTAYGIGNFLSSFLLSTVTRVTRDRGHAWVTNNLNASNLDYYYAFLTALGAVNFVAFLALSARYRYKAQSTDRIDAAVGLGTEKAKLQAEPLGX

SEQ ID NO: 10596 - protein, 433 aa, Zea mays
  misc_feature (433)..(433): Xaa can be any naturally occurring amino acid
  unsure (1)..(433): unsure at all Xaa locations
RPPPPHGAGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRKKIGVAEEWVYVFKRDREGKISWYAFDPLHQLWKSLPPVPQEYSEALGFGCAVLSGCYLYLFGGKDPLRGSMRRVVFYNARTNKWHRAPDMMRKRHFFGSCVINNCLYVAGGECEGIQRTLQSAEVYDPNRNRWACVTEMNNGMVPFIGVVYDGKWFLKGLDSHRQVTSEVYLPSSNTWSAIDDEMVTGWRNPSISFNGRLYSADCRDGCKLRVYDENTGTWTRFMDSKHHLGSSRAFEAAALVSLNGKLCVIRNNMSITLVDVSNPTMSVETDSARMWETVVRKGQHRSFVANLWSSIAGRNLKSHIIHCHVLQVX

SEQ ID NO: 10597 - protein, 229 aa, Zea mays
  misc_feature (229)..(229): Xaa can be any naturally occurring amino acid
  unsure (1)..(229): unsure at all Xaa locations
MARERREIKRIESAAARQVTFSKRRRGLFKKAQELSVLCDADVALIVFSSTGKLSQFASSSMNEIIDKYNTHSKNLGKTEQPSLDLNLEHSKYANLNEQLAEASLRLRQMRGEELEGLNVDELQQLEKNLESGLHRVLQTKDQQFLEQINDLERKSTQLAEENMQLRNQVSQIPPAGKQAVADTENVIAEEGQSSESVMTALHSGSSQDNDDGSDVSLKLGLPCVAWKX

SEQ ID NO: 10598 - protein, 182 aa, Zea mays
  misc_feature (182)..(182): Xaa can be any naturally occurring amino acid
  unsure (1)..(182): unsure at all Xaa locations
ISSLSAPPPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10599 - protein, 768 aa, Zea mays
  misc_feature (768)..(768): Xaa can be any naturally occurring amino acid
  unsure (1)..(768): unsure at all Xaa locations
MKISALLTSAGINIGLCVLFLSLYSVLRKQPANVRVYFGRRIAEEHDRLRGAFILERFVPSTGWIVKALQCTEEEILAAAGLDAVVFNRILVFSIRIFSLAAVLCVFGILPLNYFGQDIHHVRIPSESLDIFTIGNVEVKSRWLWVHCVTLYIISAVACILLYIEYKHIARLKLLHLTSATPKPNHFTVLVRGIPKADKESCSDVVDNFFTKYHSSSYLFHQVVYKVGKVQKIMTGAKKAYKKFKHFTDETVDQGCRTVTYRCCLCGASSNSFKLLNTECEQNKGKADNKSILDLDDEECTTAFVFFKTRYAALIASEILQTSNPMKWVANLAPEPEDVYWSNLWLPYKQLWARRIATLLGSIFFMFIFLIPVTFIQGLSQLEQLQQRLPFLRGILKKKYYMTQLVTGYLPSVILQIFLYIVAPIMMLFSTLEGPTSHSERKRSACCKVLYFTVWNIFFANVLSGTVISQLNVLSSPKDIPVQLAKAVPGQATFFITYVLTSGWASLSSEVMQLFGLIWNFIIKYVLRMREDTEFVPSFPYHTEVPKVLLFGLLGFTFSVLAPLILPFLLVYFCLGYVVYRNQLLNVYRTRYDTGGLYWPIAYNTVIFSLVLTQIICLGVFGLKESPVAAGFTVPLIILTLLFNQYCRNRLLPLFKTFPAQDLIDMDREDERSGRMDEIHHGLHSAYCQFADTVDVPLDKIEIVGGDEEQGSSSGQSSVKETCEDPKKHLAHPTLKGLPVNRLRHAVRSVTFLIRLQKRGLSEQKIGX

SEQ ID NO: 10600 - protein, 648 aa, Zea mays
  misc_feature (648)..(648): Xaa can be any naturally occurring amino acid
  unsure (1)..(648): unsure at all Xaa locations
SISPRTKPAKPLAHAEERERGCAGRRPASDDAGRRGVVAVKRMRLWEEEDEEGMEVDGEAEDEPGWPCGAPEAGLGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNISPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDGX

SEQ ID NO: 10601 - protein, 263 aa, Zea mays
  misc_feature (263)..(263): Xaa can be any naturally occurring amino acid
  unsure (1)..(263): unsure at all Xaa locations
DKNKYNTPKYRFVVRFTNKDITAQIISASIAGDMVLASAYSHELPRYGLEVGLTNYAAAYCTGLLLARRVLKIRGLDKEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEAEEIEALYKKVHAAIRADPSVVKSTKQPPKEHKRYNPKKLTYEQRKASLIERLNQLNSSGGADDDDEDDEX

SEQ ID NO: 10602 - protein, 304 aa, Zea mays; identical to SEQ ID NO: 9947
  misc_feature (304)..(304): Xaa can be any naturally occurring amino acid
  unsure (1)..(304): unsure at all Xaa locations

SEQ ID NO: 10603 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10604 - protein, 443 aa, Glycine max; identical to SEQ ID NO: 10343
  misc_feature (443)..(443): Xaa can be any naturally occurring amino acid
  unsure (1)..(443): unsure at all Xaa locations

SEQ ID NO: 10605 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10606 - protein, 622 aa, Glycine max; identical to SEQ ID NO: 10086
  misc_feature (622)..(622): Xaa can be any naturally occurring amino acid
  unsure (1)..(622): unsure at all Xaa locations

SEQ ID NO: 10607 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10608 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10609 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10610 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10611 - protein, 443 aa, Glycine max; identical to SEQ ID NO: 10343
  misc_feature (443)..(443): Xaa can be any naturally occurring amino acid
  unsure (1)..(443): unsure at all Xaa locations

SEQ ID NO: 10612 - protein, 630 aa, Glycine max; identical to SEQ ID NO: 10091
  misc_feature (630)..(630): Xaa can be any naturally occurring amino acid
  unsure (1)..(630): unsure at all Xaa locations

SEQ ID NO: 10613 - protein, 630 aa, Glycine max; identical to SEQ ID NO: 10091
  misc_feature (630)..(630): Xaa can be any naturally occurring amino acid
  unsure (1)..(630): unsure at all Xaa locations

SEQ ID NO: 10614 - protein, 439 aa, Glycine max
  misc_feature (439)..(439): Xaa can be any naturally occurring amino acid
  unsure (1)..(439): unsure at all Xaa locations
MRVRFPLLVLLGTVFLASVCVSLKVREDENNPFYLRSSNSFQTLFENQNGRIRLLQRFNKRSPQLENLRDYRIVQFQSKPNTILLPHHADADFLLFVLSGRAILTLVNNDDRDSYNLHPGDAQRIPAGTTYYLVNPHDHQNLKIIKLAIPVNKPGRYDDFFLSSTQAQQSYLQGFSHNILETSFHSEFEEINRVLFGEEEEQRQQEGVIVELSKEQIRQLSRRAKSSSRKTISSEDEPFNLRSRNPIYSNNFGKFFEITPEKNPQLRDLDIFLSSVDINEGALLLPHFNSKAIVILVINEGDANIELVGIKEQQQKQKQEEEPLEVQRYRAELSEDDVFVIPAAYPFVVNATSNLNFLAFGINAENNQRNFLAGEKDNVVRQIERQVQELAFPGSAQDVERLLKKQRESYFVDAQPQQKEEGSKGRKGPFPSILGALYX

SEQ ID NO: 10615 - protein, 439 aa, Glycine max; identical to SEQ ID NO: 10614
  misc_feature (439)..(439): Xaa can be any naturally occurring amino acid
  unsure (1)..(439): unsure at all Xaa locations

SEQ ID NO: 10616 - protein, 301 aa, Glycine max
  misc_feature (301)..(301): Xaa can be any naturally occurring amino acid
  unsure (1)..(301): unsure at all Xaa locations
MELETLYTPCYMPNSNWFVQESLSTEWTREDNKKFESALAIYDKDTPDRWFKVAAMIPGKTVFDVIKQYRELEEDVSEIEAGHVPIPGYLASSFTFELVDNHNYDGCRRRLAPVRGSDQERKKGVPWTEEEHRRFLMGLLKYGKGDWRNISRNFVVTKTPTQVASHAQKYYIRQKVSGGKDKRRPSIHDITTVNLTETSASDKNKPPVIAPQQKLNSMSKVQLDWTSSHYNDGSLMVFNPNSDDLFVSSSSDVTSMALKMQGQDLYECALREAYAKVKVPGFSMAPRDFNNEAVFGIHALX

SEQ ID NO: 10617 - protein, 397 aa, Zea mays
  misc_feature (397)..(397): Xaa can be any naturally occurring amino acid
  unsure (1)..(397): unsure at all Xaa locations
FPTAVTIFTANSPAGAAPSVRPFFRYRTRQSPQRSLSLAPPTQRSASAREEEMASSGYEGILLGMGNPLLDISAVVDEGFLAKYDVKPGNVILAEDKHLPMYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFNX

SEQ ID NO: 10618 - protein, 341 aa, Glycine max
  misc_feature (341)..(341): Xaa can be any naturally occurring amino acid
  unsure (1)..(341): unsure at all Xaa locations
FYLCNSNTKTMASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEAX

SEQ ID NO: 10619 - protein, 480 aa, Glycine max
  misc_feature (480)..(480): Xaa can be any naturally occurring amino acid
  unsure (1)..(480): unsure at all Xaa locations
APGPCAAALSDSCSLPNNKIQDQFPLPPRAVHSLAKEKQHIPSPPQVDSPVSVSVSVSSSSDDEDEEIVQAVVSGSIPSYSLESRLGDTRRAATIRHEVVQRLTSRSLSGLPLEGFNYDSILGQCCEMPIGFVQIPVGVAGPLLLDGKEFTVPMATTEGCLVASTNRGCKAIYVSGGASSVLLRDGMTRAPVVRFPSAQRAAQLKFFLEDPLNFDSLAVVFNKSSRFARLQNIQCAIAGKNLYMRFRCSTGDAMGMNMVSKGVQNVLDFLQSDFPDMDVIGISGNFCSDKKAAAVNWIEGRGKSVVCEAIIKEDVVKKVLKTSVEAMVKLNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQX

SEQ ID NO: 10620 - protein, 439 aa, Glycine max; identical to SEQ ID NO: 10350
  misc_feature (439)..(439): Xaa can be any naturally occurring amino acid
  unsure (1)..(439): unsure at all Xaa locations

SEQ ID NO: 10621 - protein, 622 aa, Glycine max; identical to SEQ ID NO: 10086
  misc_feature (622)..(622): Xaa can be any naturally occurring amino acid
  unsure (1)..(622): unsure at all Xaa locations

SEQ ID NO: 10622 - protein, 459 aa, Glycine max
  misc_feature (459)..(459): Xaa can be any naturally occurring amino acid
  unsure (1)..(459): unsure at all Xaa locations
MDEEYDVIVLGTGLKECILSGLLSVDGLKVLHMDRNDYYGGESTSLNLIQFELRNDDFLCPPLQLWKRFRGDDKPPPHLGASRDYNIDMNPKFIMANGNLVRVLIHTDVTKYLYFKAVDGSYVFNKGKVHKVPANDMEALKSPLMGLFEKRRARKFFIYVQNYNESDPKTHEGMDLTRVSTKELIAKYGLDDNTIDFIGHALALHSDDRYLAEPALDTVKRMKLYAESLARFQGGSPYIYPLYGLGELPQAFARLSAVYGGTYMLNKPECKVEFDEEGKVVGVTSEGETAKCKKVVCDPSYLPGKVRKVARVARAIAIMSHPIPSTDDSHSVQIILPQKQLGRKSDMYLFCCSYTHNVAPKGKFIAFVSTEAETDQPAIELKPGIDLLGPVDEIFFDIYDRYEPVNEPTLDNCFISTSYDATTHFESTVDDVLNMYTLITGKVIDLSVDLSAASAAEEX

SEQ ID NO: 10623 - protein, 262 aa, Zea mays
  misc_feature (262)..(262): Xaa can be any naturally occurring amino acid
  unsure (1)..(262): unsure at all Xaa locations
MWSFASNAIAGSLKKKAQPSKCSISNADYSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGGRAKFHSTNHDEHHSTWHSSAGTSSSHQQRRNAAVGSESSSGRETGVGRNIFHTDNISASLQKLMVCFMQLTAKFPLVIIFLLIVLYAVPASAAVLVLYALVTFLFALPSFLILYFAYPSLDWLVREIFAX

SEQ ID NO: 10624 - protein, 334 aa, Glycine max
  misc_feature (334)..(334): Xaa can be any naturally occurring amino acid
  unsure (1)..(334): unsure at all Xaa locations
MSSVSKGDRKASIDAASWLFNVVTSVGIILVNKALMATYGFSFATTLTGLHFATTTLLTLILKSLGYIQTSHLPLSDIIKFVLFANFSIVGMNVSLMWNSVGFYQIAKLSMIPVSCFLEVVLDNVRYSRDTKLSIVLVLLGVAVCTVTDVSVNAKGFIAAVIAVWSTALQQYYVHFLQRKYSIGSFNLLGHTAPAQAASLLLVGPFMDYWLTGKRVDAYGYGLTSTLFIILSCTIAVGTNLSQFICIGRFTAVTFQVLGHMKTILVLILGFIFFGKEGLNLHVVLGMIIAIAGMVWYGSASSKPGGKERRSFSLPKTQDYSSLPVSSEPDTKEX

SEQ ID NO: 10625 - protein, 413 aa, Glycine max
  misc_feature (413)..(413): Xaa can be any naturally occurring amino acid
  unsure (1)..(413): unsure at all Xaa locations
MPGPTEIVALLKAQSIQHVRLYDADQALLLALANTGIRVTVSVPNDQLLGIGQSNATAANWVTRNVIAHVPATNITAICVGSEVLTTLPNAAPILVSAINFIHSALVAANLDRQIKVSSPHSSSIILDSFPPSQAFFNRTWNPVMVPMFKFLQSTGSCLMLNVYPYYDYQQSNGVIPLDYALFRPLPPNKEAVDSNTLLHYTNVFDAVVDAAYFAMSDLNFTNIPIMVTESGWPSKGDSSEPDATVDNANTYNSNLIRHVLNNTGTPKHPGIAVSTFIYELYNEDLRSGPVSEKNWGLFYANGEPVYTLHLTGAGILFANDTTNQTFCVTKSNADPKMLQAALDWACGPGKVDCSPLLQGQPCYEPDNVVAHSTYAFNAYYQKMDKSPGSCDFKGVATVTTTDPSMAIHTPTX

SEQ ID NO: 10626 - protein, 456 aa, Oryza sativa
  misc_feature (456)..(456): Xaa can be any naturally occurring amino acid
  unsure (1)..(456): unsure at all Xaa locations
VARLRCWCRAASDPPPSRREAETLPPMTSSGAPPPAAMAVDDAEDDQLASMSTEDIVRASRLLDNEIRVLKDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYAX

SEQ ID NO: 10627 - protein, 263 aa, Oryza sativa
  misc_feature (263)..(263): Xaa can be any naturally occurring amino acid
  unsure (1)..(263): unsure at all Xaa locations
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQX

SEQ ID NO: 10628 - protein, 369 aa, Oryza sativa
  misc_feature (369)..(369): Xaa can be any naturally occurring amino acid
  unsure (1)..(369): unsure at all Xaa locations
ATSHLTYCFRQPPPDTMADSPSPRLDEEDAFGRDFNSSPSPTAPPARSGEKRPFGDLDDDDEDVFASKKGKTKVEESAPGAATGMILSLRESLQNCKDNLASCQVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVVILQDELETKDVELRRLKEMLAQKEATDENKIPQENDVAGDDIVAAAESQPIKVETX

SEQ ID NO: 10629 - protein, 622 aa, Zea mays
  misc_feature (622)..(622): Xaa can be any naturally occurring amino acid
  unsure (1)..(622): unsure at all Xaa locations
MSPNLDSAIKSQVPALLLRRLFGASRRDEAKQLQRTPAPVGRRRVFVQTETGCVLGMDLDRGDNAHTVKRRLQLAFNMPTGGTSLTFGDRVLENDLSFLRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLELMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKETLHESARAAAGQRMKQRLGTSCKFX

SEQ ID NO: 10630 - protein, 246 aa, Zea mays
  misc_feature (246)..(246): Xaa can be any naturally occurring amino acid
  unsure (1)..(246): unsure at all Xaa locations
LRDRNRGAPPPSSAMAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDDVFKSNKGESKNKTKANDDTKKQQRPFLMQFFSPIFIKAFSITFFGEWGDKSQIATIGLAADENPFGVVLGGIIAQALCTTAAVLGGKSLASQISEKMVELSSGVLFLLFGIMSLLSGPGELX

SEQ ID NO: 10631 - protein, 388 aa, Zea mays
  misc_feature (388)..(388): Xaa can be any naturally occurring amino acid
  unsure (1)..(388): unsure at all Xaa locations
AAVSRLRLRRFGLQTPGMAAGAGGGELEALEGVRSIVLKPSESLDESRFTRIAGADFNDPAIGLQGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSKX

SEQ ID NO: 10632 - protein, 328 aa, Zea mays
  misc_feature (328)..(328): Xaa can be any naturally occurring amino acid
  unsure (1)..(328): unsure at all Xaa locations
MEAQNVEVAALVQKIAALHANITKLPSLNPSPDANALFTSLVMACVPPNPVDVTKLSPDVQGMREELIRLCSDAEGHLEAHYADMLAAFDNPLDHLGRFPYFSNYIDLSKLEFDLLVRYIPGLAPSRVAFVGSGPLPFSSLVLAARHLPNTLFDNYDRCAAANDRARKLVRADKDLNARMSFHTVDVANLTDELAKYDVVFLAALVGMAAEDKAKVVAHLGRHMADGAALVVRSAHGARGFLYPIVDPEDIRRGGFDVLAVYHPDNEVINSVIIARKMDAHAKGLQNGHAHARGTVPIVSPPCKCCKMEANALQKREEMATTTELSIX

SEQ ID NO: 10633 - protein, 285 aa, Zea mays
  misc_feature (285)..(285): Xaa can be any naturally occurring amino acid
  unsure (1)..(285): unsure at all Xaa locations
KSFSHPIPNRPARHSLQPPLRLRRPPPTGAAVNRNRAMASADLLRREEEFYSSLFDSAKGDGARSRSQLIERKIEALEDMATRVSNRRSRKWFNDRLLIELVPRLYVEEIKGLFAPPPWGEQVPLSAFYRANVGEWDSFRSIDMDAEARLMQHMKKSLEKPRNHVDEGESIALNAWHRIDRHTREAIKRNFLPDLLGIYEERVRAFIEDASDKDALVLNVQDPFQRLLLHGVCEFYNVSSTTTSSVREDGRPWKATTIKKRQGTGVPSRITLVSFLRMKKNGSQX

SEQ ID NO: 10634 - protein, 233 aa, Zea mays
DLDDESGGMRGSGGRGTKRSRTAEVHNLSERRRRDRINEKMRALQELIPNCNKIDKASMLDEAIEYLKTLQLQVQMMAMGSGLCIPPMLLPRAMQLQIPSIAHFHHLGMGLGYGMGVLDMNSTAAVPFQPIPGAHYTCPMIPGTPPQGLGIGMPGTNTMPVFGVPGQAIHPSASSVQPFPSLAGLPVRPNLAPQVPAVMANMVQEQQQGVATQQQQSLNNEAQQKANTGDPQI

SEQ ID NO: 10635 - protein, 522 aa, Zea mays
  misc_feature (522)..(522): Xaa can be any naturally occurring amino acid
  unsure (1)..(522): unsure at all Xaa locations
MPGAVIVHHHTRYKTYPGEVTGIAIFSCFIASVAGCIFGYDIGLTSGLTSTEPFLVKFFPSIYEEMKRQVVVNQYCKFDSQVLTLFSSSLFLAATVATFFAGPMTRAFGRKWTLFAAASAYVVGACIGGVSVNFPMLLTGRVLVGSGVGISIQAAPLYISEVAPAQQRGMLNILFQLMITVGILTANMTNYLASKVSGGWGWRIPVTFGAIPAAVIALGALAIPDTPASLVERGDTATARKTLSQIRGVGDVREEFDDLAAASEDAKAVQCPWRELFFGGKYKPQLTFALLIPFFQQLTGINVIMFYAPVLFKTVGFKQNATLVSSVITGLVNVFSTFVAIATADKIGRRALFLQGGTQMIISQILVGTFIGLQFGMSGTGDISEQYAMCIVLFVCVYVAGFAWSWGPMGWLVPSEIYPLAVRSAAMSVTVAVNMFFTAFIGQIFLTLLCHLRFGLFYFFGAWVLLMTLFIAMLLPETKSVPVEEMAHVWKKHWFWRKFVIDTGNDARNAEMRKRIALEMSX

SEQ ID NO: 10636 - protein, 189 aa, Zea mays
  misc_feature (189)..(189): Xaa can be any naturally occurring amino acid
  unsure (1)..(189): unsure at all Xaa locations
SRFTVRHKHTTRATAADLRPAVPMSSSGPLLATGTHHTGRQPEVLWAQRSEKIFLTISLPDAKDVVLKTDPKGLFNFSAVVHGEPFSFTLELFDSILSEGSKTKTKMGLRNIICSIQKEKKGWWKRLLKSEEKHPYIKVDWNKWCDEDEESEFSGDSDGGFDEANEGDESDDDDGMLYLPDLEKLRGKX

SEQ ID NO: 10637 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10638 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10639 - protein, 556 aa, Zea mays
LLRSLLNADLIGFHTFDYARHFLSCCSRMLGLKYESQRGYIALEYYGRTVTIKILPVGVHLEQLRSVLNLPELGVKVAELLKQFCHRNRLLLLGVDDMDIFKGISLKLLAFEQLLMQHPEWRGRVVLVQIANPARGRGKDVREVQEESDAMVRRINDAFGQPGYQPVILIDQPLQFYERMAYYVVAECCLVTAVRDGMNLIPYEYVIARQGNERIDSILGLGPASRKKSMLVVSEFIGCSPSLSGAIRVNPWNIDSVADAMDYALEMPEGEKVLRHEKHHRYVSTHDVGYWANSFLQDLERICLDHNRRRCWGIGFGLKFRVVALDPNFKKLAVEHLVLAYRRTKKRVILLDYDGTLMPQTSLGKSPTSRTIDMLNSLCRDRNNMVFLVSAKSRMTLNEWFLPCESLGLAAEHGCFLRLRRDAEWETCVPVIDCSWKQIAEPVMKTYTETTDGSTIEDKETAIVWCYEDADPDFGSCQAKELHDHLESVLANEPVSVKAGPNLVEVKPQGVSKGLVAKRILSTTQERGDADDDLPDFVLCVGDDRSDEDMFEVIAA

SEQ ID NO: 10640 - protein, 170 aa, Zea mays
  misc_feature (170)..(170): Xaa can be any naturally occurring amino acid
  unsure (1)..(170): unsure at all Xaa locations
LAASGSVAAIKFEVLCRSVAEWADVQAVATASALEFIDVASFPGGVPLYTDDQEWSSWKRVGDKVLHIELRRWADVLVIAPLSANTLAKVAGGLCDNLLTCVVRAWDYSKPVYVAPAMNTFMWDNPFTARHLAVLRDLGMSVVPPVNGAMAEPSEICKTLMLFFGPQHLX

SEQ ID NO: 10641 - protein, 251 aa, Zea mays
  misc_feature (251)..(251): Xaa can be any naturally occurring amino acid
  unsure (1)..(251): unsure at all Xaa locations
STPRPLRDRNRGAPPPSSAMAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDAVFKSNKGESKTKTKANDDTKKQQRPFLMQFFSPIFIKAFSITFFGEWGDKSQIATIGLAADENPFGVVLGGIIAQALCTTAAVLGGKSLASQISEKMVELSSGVLFLLFGIMSLLSGPGELX

SEQ ID NO: 10642 - protein, 647 aa, Zea mays
  misc_feature (647)..(647): Xaa can be any naturally occurring amino acid
  unsure (1)..(647): unsure at all Xaa locations
GEKRLSESTPARGAEVGMGGGLDEAVKVVDLEDGEGEEEAEAAAAEGSSMEMGMLPRMPVRVLLAEGDDSTRHVISALLRKCGYRVAAASDGVKAWDLLKEKSFKVDLVLTEVELPLMSGFLLLSTIMEHDASKNIPVIMMSSHDSVSMVFKCMLKGAADFLVKPIRKNELRNLWQHVWRKQLANGGPNVQHIQREENLAERIQQKTGVTKADNLDRDVPCKNRECSEQESDAQSSCTRSELEAESKQTDNILEYKQSTQRHLSIPSHKNVELNGQTKIQRAKGNNLIPASEDDLSPKKRTCLNENNSERASRDMELVHIMENQQKYNTQWEVDTMRTTSRGNDEKGSIPAHQLELSLRRTDYGKLENHEKNDRRTLNHSTSSAFSLYNCRAVPTLGNAGDGQLCSTSETLVDVENKNGDSADPSQDMTETNRPPIRVVPVPVQGLTFDGQPFWNGTPVASLFYSQSTPPIWNSKTSMWQESTPQATSLPQKSPQNEPNEMGAKPVINAGEQFAMGPPSASGKQLHVEILNDDPRHISPMTGESGISTVLDSTRNTLSSSGCDSISNQITAPTESSNVYKDVPETPSAEGSRHLSQREAALNKFRLKRKDRCFEKKVRYQSRKLLAEQRPRVKGQFVRQDHSIQGSX

SEQ ID NO: 10643 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10644 - protein, 236 aa, Zea mays
  misc_feature (236)..(236): Xaa can be any naturally occurring amino acid
  unsure (1)..(236): unsure at all Xaa locations
TMAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALFX

SEQ ID NO: 10645 - protein, 387 aa, Zea mays
  misc_feature (387)..(387): Xaa can be any naturally occurring amino acid
  unsure (1)..(387): unsure at all Xaa locations
ARGASLRRPAPAFLLYLRRGDPRQPSTPLTLPKPELSRSQDADPNQRPLPALYSPTTPQPTAMSATATDEAAVEARLQELRGRLGKKQHFEEAVNELAAAVRDRYAGASPALRKAMYSTVCRVATVLQTRYTAPGFWHVGLNLFVGIEKLVSNPAEKEHLKTCISRAREHLDEKENEDSVPSNREADTRFLFEGHLTVGQEPPPPAWLVAQNLTRELSILTESSGDQDGSNNRTVPRAEEITPAIMNLLETISGDRDLETALEESLQGIIEYPQRAPPASKEVVANLPVIAVTEEVMSRLGSETECAVCRENLVVDDKMQELPCKHLFHPLCLKPWLDENNSCPICRHELRTDDHVYESRKEREREEEEDRRGAANAVRGGEFIYIX

SEQ ID NO: 10646 - protein, 195 aa, Zea mays
  misc_feature (195)..(195): Xaa can be any naturally occurring amino acid
  unsure (1)..(195): unsure at all Xaa locations
SSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 10647 - protein, 263 aa, Zea mays
  misc_feature (263)..(263): Xaa can be any naturally occurring amino acid
  unsure (1)..(263): unsure at all Xaa locations
RATAPARRPSIHRHPLAQSKGTLAMSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 10648 - protein, 255 aa, Zea mays
  misc_feature (255)..(255): Xaa can be any naturally occurring amino acid
  unsure (1)..(255): unsure at all Xaa locations
LSSSGVQLRPESRHGQQLNAPPPPRSHARPTGTASSHPSTATAKLLLADSNMTEEEAKKVEVEVEVTKAAPAKENAAEEKAVIPATEPPAAQEKPPAPADDSKALAIVEKVADKSAPEKPIAEKQGGSSIRDLALARVETEKRNSLIKAWEDNEKAKADNKATKKVSVILSWENTKKANIEAGMKKIEEQLENKKAEYAEKMKNKVAMIHREAEEKRAMVEAKRGEEVLKAEEMAAKYRATGHAPKKPIGCFGAX

SEQ ID NO: 10649 - protein, 166 aa, Zea mays
PRLRGVRKRPWGRYAAEIRDPVRKARVWLGTFDTPEQAARAYDAAARRLRGPRATTNYPGDVVREAPCTAPALAASASGSTESSSSSSSRDDGHPPPPLPTAPSSLGLGLGLFPATVATQPCLFLDPAPVEREEGERERSCCSRSPPSVLAGLGFDFDLNLPPPAE

SEQ ID NO: 10650 - protein, 226 aa, Zea mays
  misc_feature (226)..(226): Xaa can be any naturally occurring amino acid
  unsure (1)..(226): unsure at all Xaa locations
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKDQLFMQQIGELLQKGTQLEDENRRLKEQMPQVLTAGTMVVAAAAENILTEDGQSSESVMTALHSGSSLDCDDGSDISLKLSLPX

SEQ ID NO: 10651 - protein, 522 aa, Zea mays; identical to SEQ ID NO: 10635
  misc_feature (522)..(522): Xaa can be any naturally occurring amino acid
  unsure (1)..(522): unsure at all Xaa locations

SEQ ID NO: 10652 - protein, 473 aa, Zea mays
  misc_feature (473)..(473): Xaa can be any naturally occurring amino acid
  unsure (1)..(473): unsure at all Xaa locations
MAFYRGLTAVSRLRSRMAQEATTLGGVRWLQMQSASDLDLKSQLQELIPEQQDRLKKLKSEHGKTQLGNITVDMVLGGMRGMTGMLWETSLLDPEEGIRFRGLSIPECQKVLPTAVKGGEPLPEGLLWLLLTGKVPTKEQVDALSKELLARSTVPAHVYKTIDALPVDAHPMTQFTTGVMALQVESEFQKAYDNGLPKSKFWEPTYEDCLNLIARLPPVASYVYRRIFKSGKSIEADNSLDYAANFSHMLGFDDQKMLELMRLYVTIHTDHEGGNVSAHTGHLVGSALSDPYLSFAAALNGLAGPLHGLANQEVLLWIKSVIEETGSGVTTDQLKDYVWKTLKSGKVVPGFGHGVLRKTDPRYSCQREFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCKNKAAX

SEQ ID NO: 10653 - protein, 360 aa, Zea mays
  misc_feature (360)..(360): Xaa can be any naturally occurring amino acid
  unsure (1)..(360): unsure at all Xaa locations
MTRCRAPDAIPGPALAEYYAQRSTEGGLLISEGTIISPSGPGFPRVPGIYNQEQTDAWRKVVDAVHAKGAIFFCQLWHVGRASHQVYQPGAAAPISSTDKPISSRWRILMPDGSYGKYPTPRRLATSEIPEIVEQYRQAAVNAIKAGFDGIEIHGAHGYLIDQFLKGGINDRTDEYGGSLSNRCRFLLEVTRAVVSAIGADRVAVRVSPAIDHLDAYDSNPLQLGLAVVERLNALQQEAGRLAYLHVTQPRYTAYGQTESGQHGSAEEESRLMRAVRGAYRGTFMCSGGYTRELGVEAIESGDADLVSYGRLFIANPDLVERFRRDAPLNKYVRKTFYTPDPVVGYTDYTFLGQPKARMX

SEQ ID NO: 10654 - protein, 231 aa, Zea mays
  misc_feature (231)..(231): Xaa can be any naturally occurring amino acid
  unsure (1)..(231): unsure at all Xaa locations
AHGSRCPPHVKVGAFVSYLSSRSSTSHFLLRPHQGHTASACGKILPHSPNMRGAEEERSGAATDAGGEEEKRERSVGLMAGLMDKAKGFVVEKVTQIPKPEAALDHVSFQSISREGVELHSHVDISNPYSHRIPICEITYTFKSAGKVIASGTMPDPGWIAASGSTKLDLPVKVPYDFIVSLMKDLGGDWDIDYMLEVGLTVDLPAIGAFTIPLTTEGEIKLPTFRDLLFX

SEQ ID NO: 10655 - protein, 372 aa, Zea mays
  misc_feature (372)..(372): Xaa can be any naturally occurring amino acid
  unsure (1)..(372): unsure at all Xaa locations
MGSGGANTAPLLTPYKMGKFDVTHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDVX

SEQ ID NO: 10656 - protein, 512 aa, Zea mays
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSN

SEQ ID NO: 10657 - protein, 245 aa, Zea mays
  misc_feature (245)..(245): Xaa can be any naturally occurring amino acid
  unsure (1)..(245): unsure at all Xaa locations
MGRGRVELKRIENKINRQVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLPX

SEQ ID NO: 10658 - protein, 184 aa, Zea mays
  misc_feature (184)..(184): Xaa can be any naturally occurring amino acid
  unsure (1)..(184): unsure at all Xaa locations
MINLFKIKGQKKEEAASAAGKAPVKKQSAGELRLHKDISELNLPKTTSISFPNGKDDLMNFETTIRPDEGYYMGGTFVFTFQVSSSYPHDPPKVKCKTKVYHPNIDLEGNVCLNILREDWKPVLNINTVIYGLNLLFTQPNDEDPLNHEAAVVLRDNPKMFEANVRRAMAGGYVGQHYFQRCAX

SEQ ID NO: 10659 - protein, 353 aa, Zea mays
PDDFRCPITLEVMTDPVILPSGHTFERRSIQSWLDGGHLTCPVTNLPLPPSPPLIPNHALRRLIAAVSPSAAASLVPAEGGAHARQEAVSAAAAAAVPARPASPVPALLRLAKSGAAGRKEVLESGSAAVLLRHAEAGDEAAARALLHLSLDGDDTRVGLVADGAVDALSAAVSRGGAAAASAATALTSLATVDVNKCTIGAHPSAIPALAGLLRRGGPRERREAATALYELCKLPENRRRAVREGAAPALADFAAAGSARAVEVLGLLARCREGRQELCRVPGVVSVLTGAAGSGNARAIEQALLVLNWICSESNELAVEAIKLQAFDLCEALVNDDNCKIAKNAVDLARTL

SEQ ID NO: 10660 - protein, 260 aa, Zea mays
  misc_feature (260)..(260): Xaa can be any naturally occurring amino acid
  unsure (1)..(260): unsure at all Xaa locations
MRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVISAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLGX

SEQ ID NO: 10661 - protein, 655 aa, Zea mays
  misc_feature (655)..(655): Xaa can be any naturally occurring amino acid
  unsure (1)..(655): unsure at all Xaa locations
ENRERSDKLLSESTPARRSAEVEMGGGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGAADFLVKPLRKNELRNLWQHVWRKQLANGGPDVQHIQEENLAERMEQKTGVTKADNLNSDGPHKNRECSEQESDAQSSCTRSELEAESKQTNNILEYMQSTERHLFIRSHKDLELNGETKTRTKGNNLIPTREDDLLPKKRTCLNDNDSERTSRDMELVHIMDNQQKHDTQRDVDTMRTTSRGNDEKNSIPAHQLELSLRRTDYGKLENHEKNDRRTLNHSTSSAFYLYNCRTASSLGNAGDGQLCSTSETLVDVENRNGDLAALSEDTTETNRPPIRVVPFPVPVQCFTFDGQPFWNGTPVASPFYPQSAPPIWNSKTPTWQESTPQATSLPQKSQQNEPVEMDAKPVENAEEQFVVGPPSASGKQLHVEIPKDGLRHISPVTGESGISTVLDSTRNTLSSSGCDSTSNRITASTEPSSNVYRGVPETARAEGLRHLSQREAALNKFRLKRKDRCFEKKVRYQSRKLLAEQRPRVKGQFVRQDHSIQGSX

SEQ ID NO: 10662 - protein, 150 aa, Zea mays
  misc_feature (150)..(150): Xaa can be any naturally occurring amino acid
  unsure (1)..(150): unsure at all Xaa locations
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 10663 - protein, 389 aa, Zea mays
  misc_feature (389)..(389): Xaa can be any naturally occurring amino acid
  unsure (1)..(389): unsure at all Xaa locations
EAAVSRLRLRRFGLQTPGMAAGAGGGELEALEGVRSIVLKPSESLDESRFTRIAGADFNDPAIGLQGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSKX

SEQ ID NO: 10664 - protein, 266 aa, Zea mays
  misc_feature (266)..(266): Xaa can be any naturally occurring amino acid
  unsure (1)..(266): unsure at all Xaa locations
ANAHAPTRHIQMMLRVSPSPAAAVPTQLSGAPATPAPVVRVAAPRGVASPSAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPQLTDFIESEFLEEQVEAINKISKYVAQLRRVGKGHGVWHFDQMLLEEEAX

SEQ ID NO: 10665 - protein, 466 aa, Zea mays
  misc_feature (466)..(466): Xaa can be any naturally occurring amino acid
  unsure (1)..(466): unsure at all Xaa locations
VRSRRRRQAGREREREREMDEEYDVIVLGTGLKECIISGLLSVDGLKVLHMDRNDYYGGESSSLNLTKLWNRFKGNDSPPEHLGVSKEYNVDMVPKFMMANGALVRVLIRTSVTKYLNFKAVDGSFVYNNGKIHKVPATDVEALKSNLMGLFEKRRARKFFIYVQDYEEDDPKSHEGLDLNKVTTREVISKYGLEDDTVDFIGHALALHRDDSYLDEPAIDTVKRMKLYAESLARFQGGSPYIYPLYGLGELPQAFARLSAVYGGTYMLNKPECKVEFDESGKAYGVTSEGETAKCKKIVCDPSYLPDKVKKVGRVARAICIMKHPIPDTKDSHSVQIILPKKQLKRKSDMYVFCCSYAHNVAPKGKFIAFVSTEAETDKPEIELKPGIDLLGPVEETFFDIYDRYEPVNNPDDDCCFLTNSYDSTTHFETTVKDVLALYNKITGKELDLSVDLNAASATEQEAAX

SEQ ID NO: 10666 - protein, 186 aa, Zea mays
  misc_feature (186)..(186): Xaa can be any naturally occurring amino acid
  unsure (1)..(186): unsure at all Xaa locations
MEDGSAPRRSTPPARRSRSAEFHNFSERRRRDKINEKLKALQELLPNCNKTDKVSMLDEAIDYLKSLQLQLQMLVMGKGMSPVVPLELQQYMHYITADPAQLPPLRPSGQQHRQFQITQANPQRQSNVESDFLSQMQNLHSSEPPQNFLRPPKLQLYTPEQRGGLPSTSHNTGWISGSSSYNFMEX

SEQ ID NO: 10667 - protein, 270 aa, Zea mays
  misc_feature (270)..(270): Xaa can be any naturally occurring amino acid
  unsure (1)..(270): unsure at all Xaa locations
RARVLTRPCSSPRLLYQSTSTPRPLRDRNRGAPPPSSAMAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDAVFKSNKGESKTKTKANDDTKKQQRPFLMQFFSPIFIKAFSITFFGEWGDKSQIATIGLAADENPFGVVLGGIIAQALCTTAAVLGGKSLASQISEKMVELSSGVLFLLFGIMSLLSGPGELX

SEQ ID NO: 10668 - protein, 253 aa, Zea mays
  misc_feature (253)..(253): Xaa can be any naturally occurring amino acid
  unsure (1)..(253): unsure at all Xaa locations
MMLRVSASPAAAVANHLSGGAAATTAPARVTAQRSGVSLSAAAAAGKGKEVLSGVVFQPFEEIKGELALVPQSPDRSLARHKFVDDCEAAINEQINVEYNASYAYHSLFAYFDRDNVALKGFAKFFKESSDEEREHAEKLMEYQNKRGGRVRLQSIVAPLTEFDHPEKGDALYAMELTLALEKLVNEKLHSLHGVATRCNDPQLIDFIESEFLEEQVEAINKVSKYVAQLRRVGNKGHGVWHFDQMLLQEGAX

SEQ ID NO: 10669 - protein, 163 aa, Zea mays
  misc_feature (163)..(163): Xaa can be any naturally occurring amino acid
  unsure (1)..(163): unsure at all Xaa locations
ATKVTFPLVWTNTCCSHPLYRESELIQENYLGVRNAAQRKLLDELGIPAEDAPVDQFTPLGRMLYKAPSDGKWGEHELDYLLFIVRDVKVQPNPDEVADVKYVNRDELKELIRKADAGEDGVKISPWFRLVVDNFLMGWWDHVEKGTLGEAVDMETIHKLKEX

SEQ ID NO: 10670 - protein, 463 aa, Zea mays
  misc_feature (463)..(463): Xaa can be any naturally occurring amino acid
  unsure (1)..(463): unsure at all Xaa locations
GDHGAALPLIADQAKHAAAGGIVRSGSMWTAAAHVITAVIGSGVLSLAWSIAQLGWVAGPAAMLVFAAVTALQSTLFADCYRSPDPEHGPHRNRTYAKAVDRNLGSNSSWVCMLLQHTALFGYGIAYTITASISCRAILKANCYHEHGHDAHCDYDGNYYMLIFGGVQLLLSFIPDFHDMAWLSVVAAAMSFSYAFIGLGLGLARTIANGTIKGSITGVRMRTPMQKVWRVSQAIGDIAFAYPYSLILLEIQDTLKSPPAENKTMKRASMISILVTTFFYLCCGCLGYAAFGSDAPGNLLTGFGLYGPYWLIDFANACIILHLLGGYQVYSQPIFQFAERLLAERFPDSGFVNGGSYTVRFACLRACRVNPLRVCLRTLYVASTTAVAVALPYFNEVLALLGALSFWPLAIYFPVEMYFIQRNVRRWSARWVVLQTFSVVCLLVSAFALVGSIEGLISKKLGX

SEQ ID NO: 10671 - protein, 286 aa, Zea mays
  misc_feature (286)..(286): Xaa can be any naturally occurring amino acid
  unsure (1)..(286): unsure at all Xaa locations
SQTGSSRVQAAAKMMAEAWTPVPFPPTAPCFWLHDTHSVFWRGGDAWTAAENKLFEKALAQIDRNAPDRWEKVAEVVRTKTVDDVRNHYHDLENDVGFIEAGLVPFPHYSGSVPSFGFTHEDWDGGFRRGYCLKRARGSDPERKKGVPWTEEEHKLFLMGLKKYGRGDWRNISRKYVTTRTPTQVASHAQKYFIRLNSGGKDKRRSSIHDITTVNLPDEDRGNAPPSAVTTTTNPSVALVDMKPFVAPSLGVPHPYGDVKLEPKSSLVAGLGFNDSVLLMHCGQLX

SEQ ID NO: 10672 - protein, 179 aa, Zea mays
  misc_feature (179)..(179): Xaa can be any naturally occurring amino acid
  unsure (1)..(179): unsure at all Xaa locations
NAFLPSPKTSSDPRSAAAAMDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKAX

SEQ ID NO: 10673 - protein, 312 aa, Glycine max
  misc_feature (312)..(312): Xaa can be any naturally occurring amino acid
  unsure (1)..(312): unsure at all Xaa locations
MDCSSWINTSLDLNINPRRVHEEVPKEVESELFSLGMTKFNVEEESTSDLEEELKRVTAENKKLAEMLSVVCENYNTLRNHLMECMRKNGEKEVSPTSKKRKSESSNNNSNLMGTNNGNSESSSTDEESCKKPREEIIKAKISRVYVRTEASDTSLIVKDGYQWRKYGQKVTRDNPCPRAYFKCSFAPSCPVKKKVQRSVDDQSVLVATYEGEHNHPQFSSQMEATSGSGRSVTLGSVPCTASLSTSTPTLVTLDLTKSQGSNDSKSTKPKGDSPKVPQVLVEQMATSLTTDPNFRAALVAAISGRLLHNNX

SEQ ID NO: 10674 - protein, 377 aa, Glycine max
  misc_feature (377)..(377): Xaa can be any naturally occurring amino acid
  unsure (1)..(377): unsure at all Xaa locations
KKRETDRTMGEAKGKEEEVLASVHSTVFKESESLDGKCVKIEGYDFNRGVNYPLLLSSMVTTGFQASNLGDAIQVVNQMLDWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENVLWTPSKLIARLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHCDATIAFPLLVAETFASKVKPPHX

SEQ ID NO: 10675 - protein, 518 aa, Glycine max
  misc_feature (518)..(518): Xaa can be any naturally occurring amino acid
  unsure (1)..(518): unsure at all Xaa locations
EAQQLLQLFCIACSRSCCCSLLKKESLQDKMVEKDGVGSKYLQQTLNVSIDMHQHGISKCFDDDGRPKRTGTVWTSSAHIITAVIGSGVLSLAWAIAQLGWIAGPIVMVIFSAITYYTSTLLADCYRTGDPVTGKRNYTYMDAIQSNFGGNGFKVKLCGLVQYVNLFGVAIGYTIAASTSMMAIERSNCFHKSGGKDPCHINSNMYMISFGIVEILFSQIPGFDQLWWLSIVAAVMSFTYSTIGLGLGIGKVIENGGVGGSLTGITIGTVTQTDKVWRTMQALGDIAFAYSYSLILIEIQDTVKSPPSESKTMKKASFISVAVTSIFYMLCGCFGYAAFGDASPGNLLTGFGFYNPYWLLDIANAAIVIHLVGSYQVYCQPLFAFVEKHAAQMFPDSDFLNKEIEIPIPGFHPYRLNLFRLVWRTIYVMLSTVISMLLPFFNDIGGLLGAFGFWPLTVYFPVEMYIIQKRIPKWSTKWICLQILSMTCLLMTIGAAAGSIAGIAIDLRTYKPFKTNYX

SEQ ID NO: 10676 - protein, 244 aa, Zea mays
  misc_feature (244)..(244): Xaa can be any naturally occurring amino acid
  unsure (1)..(244): unsure at all Xaa locations
QHRKHNSVPTMAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPIAFLTQQQLLPFYLHAAPNAGTLLQLQQLLPFNQLALTNPTAFYQQPIIGGALFX

SEQ ID NO: 10677 - protein, 158 aa, Zea mays
  misc_feature (158)..(158): Xaa can be any naturally occurring amino acid
  unsure (1)..(158): unsure at all Xaa locations
LAWPTLMLQQLLASPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSISHIIQQQQLPFMFSPTAVAISPMFLQQPFVGAAFX

SEQ ID NO: 10678 - protein, 183 aa, Zea mays
  misc_feature (183)..(183): Xaa can be any naturally occurring amino acid
  unsure (1)..(183): unsure at all Xaa locations
SAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10679 - protein, 157 aa, Zea mays
  misc_feature (157)..(157): Xaa can be any naturally occurring amino acid
  unsure (1)..(157): unsure at all Xaa locations
EMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRNX

SEQ ID NO: 10680 - protein, 272 aa, Gossypium hirsutum
  misc_feature (272)..(272): Xaa can be any naturally occurring amino acid
  unsure (1)..(272): unsure at all Xaa locations
EDIWGDHMHHGYYDPGSDVSGSDHRAAQIRMIEESLRFAGISDDPANRPKRIVDVGCGIGGSSRYLARKYGAKCQGITLSPVQAGRANALANAQVLADQVCFEVADALNQPFPDDQFDLVWSMESGEHMPDKPKFVEELVRVAAPGGTIIVVTWCHRDLGPSEESLQPWEQKLLNRICDAYYLPEWCSTSDYVKLFQSLSLQDIKAGDWTENVAPFWPAVIRSALTWKGFTSLLRSGLKTIKGALVMPLMIEGFQKGVIKFAIIACRKPAEX

SEQ ID NO: 10681 - protein, 355 aa, Zea mays
  misc_feature (355)..(355): Xaa can be any naturally occurring amino acid
  unsure (1)..(355): unsure at all Xaa locations
MHPKARIHADPVREVDHFDCLPDSLVLLILNKVEDVRSLGRCYAVSKRLCGLVSLVHDVYVKIDRVVAVDGDAEGTLNLSSPKPRSIFSHFLRLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKTLMKRRTYLLEMNGFX

SEQ ID NO: 10682 - protein, 355 aa, Zea mays
LHIKGRPMGKKKKRVDKVFCYYCDREFDDEKILVQHQKAKHFKCHVCHKKLSTASGMAIHVLQVHKESVTKVPNAKPDRESTEIEIFGMQGIPAHVLAAHYGEEEDPSTKVPKVEVPQVRPVIMPNSLGMAFPPRPAYGVAPPIYNPALNPLMARPPIWPAAPAQAWYSQQAAYPQQSAVSVPPIVAGLPPQQPLFPIQNVPTPMTSAAANVLQTSFPMAPPGVPSPVAPHVSQPLFPVNTSAVNGAVNSPFLASVAPGTIPASSSAAVGVAGIGYGTNNQGTRDPAVGSSPAVSNNKASGAQPATNEVYLVWDDEAMSMEERRLSLPKYQVHDETSQMNSVDAAIDRRISESRL

SEQ ID NO: 10683 - protein, 511 aa, Zea mays
  misc_feature (511)..(511): Xaa can be any naturally occurring amino acid
  unsure (1)..(511): unsure at all Xaa locations
PESSRMASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKLX

SEQ ID NO: 10684 - protein, 483 aa, Zea mays
LRASSMASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLDPSEPTHTKVKQLLFSLLLSRKDDVIPTFRSNFSSLLATVEAELAKGGKAEFNKLNDVTSFDFIGEAYFGVRPSATDLGKGGPTKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAGDFVPDRFLGEEGSKLLQYVYWSNGRETENPSVDNKQCPGKNFVVLVGRLLLVELFLRYDTFTAEVGKELLGTSVIFTGVTKATSG

SEQ ID NO: 10685 - protein, 168 aa, Zea mays
MEYGQQGQRGHGATGHVDQYGNPVGGVEHGTGGMRHGTGTTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 10686 - protein, 382 aa, Zea mays
MAVLSAAGAPPASAIGFEGYEKRLEITFSEAPVFVDPHGSGLRALSRSQIDSVLDLARCTIVSELSNKDFDSYVLSESSLFIYPLKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEE

SEQ ID NO: 10687 - protein, 259 aa, Zea mays
  misc_feature (259)..(259): Xaa can be any naturally occurring amino acid
  unsure (1)..(259): unsure at all Xaa locations
VNESLLSKLREGKLTVSLDPIFYPSSAMASRQQHPTSYHAGETKARAEEKTGQVMGATQEKGREAKHKASDASDRAMGMGHDAMEATREKARAAADRTMGMGHDAGEAAKDRAYRAKDAASGAAGRARDTASDAAGAAGDRARDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDYX

SEQ ID NO: 10688 - protein, 489 aa, Zea mays
  misc_feature (489)..(489): Xaa can be any naturally occurring amino acid
  unsure (1)..(489): unsure at all Xaa locations
MAGNALANYVQVYVMLPLDVITVDNTFEKEDETRAQLKKLTEAGADGVMIDVWWGLVEGKEPGVYDWSAYRQVFKLVQEAGLKLQAIMSCHQCGGNVGDVVNIPIPQWVRDVGKSNPDIFYTNRSGVTNIEYLTLGVDDQPLFHGRTAIQLYADYMKSFRENMADFLDAGVVVDIEVGLGPAGEMRYPSYPQSQGWVFPGVGEFICYDKYLQADFKAAAEEAGHPEWDLPDDAGTYNDTPEKTQFFADNGTYQTDKGKFFLTWYSNKLIKHGDKILDEANKVFLGCKVQLAIKVSGIHWWYNVPNHAAELTAGYYNLDDRDGYRTIAHMLTRHRASMNFTCAEMRDSEQSSEAKSAPEELVQQVLSAGWREGLNLACENALNRYDATAYNTILRNARPQGINKNGPPEHKLHGFTYLRVSDELFQEQNYTTFKTFVRRMHANLDYNPNVDPVAPLERSKAEIPIEEILEVAQPKLEPFPFDKDTDLPVX

SEQ ID NO: 10689 - protein, 315 aa, Glycine max
  misc_feature (315)..(315): Xaa can be any naturally occurring amino acid
  unsure (1)..(315): unsure at all Xaa locations
QLIKLGGVRFRKERKGNQKMAQSSSIVVTLRQHLFKRNLTSLTLPHSPSLPSFSFSLRTTPHTPLSLSASFSSHTSMAHTSLPSADAGMDAVQRRLMFEDECILVDENDRVVGHDSKYNCHLMEKIEAENLLHRAFSVFLFNSKYELLLQQRSATKVTFPLVWTNTCCSHPLYRESELIDENALGVRNAAQRKLLDELGIVAEDVPVDKFTPLGRILYKAPSDGKWGEHELDYLLFIVRDVNVNPNPDEVADIKYVNRDQLKELLRKADAGEEGLKLSPWFRLVVDNFLFKWWDHLEQGTLGEATDMKTIHKLTX

SEQ ID NO: 10690 - protein, 117 aa, Gossypium hirsutum
  misc_feature (117)..(117): Xaa can be any naturally occurring amino acid
  unsure (1)..(117): unsure at all Xaa locations
TLFALVIAITKDLPDVEGDRKFQISTLATKLGVRNIAFLGSGLLLVNYVAAVLAAIYMPQAFRRSLMIPAHIFLAVCLIFQTWVLEQANYKKEAISGFYRFIWNLFYAEYAIFPFVX

SEQ ID NO: 10691 - protein, 177 aa, Zea mays
  misc_feature (177)..(177): Xaa can be any naturally occurring amino acid
  unsure (1)..(177): unsure at all Xaa locations
SLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10692 - protein, 223 aa, Zea mays
  misc_feature (223)..(223): Xaa can be any naturally occurring amino acid
  unsure (1)..(223): unsure at all Xaa locations
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCQWESVQAPWLIEX

SEQ ID NO: 10693 - protein, 149 aa, Zea mays; identical to SEQ ID NO: 5266

SEQ ID NO: 10694 - protein, 161 aa, Zea mays
MDGRMFGLETPLMVALQHLLDVPDGDAGAGGDKAGGGGPTRTYVRDARAMAVTPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 10695 - protein, 154 aa, Zea mays; identical to SEQ ID NO: 5911

SEQ ID NO: 10696 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10697 - protein, 505 aa, Zea mays
  misc_feature (505)..(505): Xaa can be any naturally occurring amino acid
  unsure (1)..(505): unsure at all Xaa locations
SFHFPISQIQFASSSSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10698 - protein, 448 aa, Zea mays
  misc_feature (448)..(448): Xaa can be any naturally occurring amino acid
  unsure (1)..(448): unsure at all Xaa locations
EMAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPYX

SEQ ID NO: 10699 - protein, 345 aa, Zea mays
  misc_feature (345)..(345): Xaa can be any naturally occurring amino acid
  unsure (1)..(345): unsure at all Xaa locations
MGILCLGASSTLLCGEDRNNVLGLGCGNELVEVGSGHDGLDSVVGAVFPVDTDEAVRALLEKETDHKPQDGYAERLERGGLEYSWRRDAMDWICKVHSYYRFGPLSLYLAVNYLDRFLSSYDLPHDKPWMRQLLSVACLALAVKMEETVLPLPVDLQVCDVKFEFEARTIGRMELLVLATLKWRMQAVTPFTFISYFLDKFNGGKPPSMALASRCTEIIIGTLKGSTFLSFRPSEIAAASALAAVSENQVVGSSSALSASEVPINKEMIARCYELLQEQALVRKTGHINGSPSVPQSPIGVLDATCFSFRSEDVRLGSSQSNNISSSSNDNQVSKRRRLSISPIX

SEQ ID NO: 10700 - protein, 253 aa, Zea mays
VNILKQNNVNSEGCLFDKHARTALAFVTLKHDGEREFMFYRNPSADMLLTEAELDLGLVRRAKVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKA

SEQ ID NO: 10701 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10702 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10703 - protein, 348 aa, Zea mays
  misc_feature (348)..(348): Xaa can be any naturally occurring amino acid
  unsure (1)..(348): unsure at all Xaa locations
ADALRSPFPFRSFSTPHPLPDMADNAKAAAAHARPESSQEEEEDWKEAEGDVAEVDRAATNGAGEGGVPTDRPIRVYADGIYDLFHFGHAKSLEQAKKSFPNTYLLVGCCNDELTHKFKGRTVMTEDERYESLRHCKWVDEVIPDAPWVVTEEFLDKHNIDFVAHDSLPYADASGAGNDVYEHVKKLGKFKETQRTDGISTSDIIMRIVKDYNEYVMRNLARGYTRKDLGVSYVKEKRLRVNMGLKNLRDRVKQHQEKVGEKWSTVAKLQEEWVENADRWVAGFLEKFEEGCHSMGTAIKERIQERLIKAQSSDFGSLLQYDSYDSDEAKENDEDEDEDELFEDVKEX

SEQ ID NO: 10704 - protein, 460 aa, Zea mays
  misc_feature (460)..(460): Xaa can be any naturally occurring amino acid
  unsure (1)..(460): unsure at all Xaa locations
ASFRGLVFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 10705 - protein, 196 aa, Arabidopsis thaliana
EVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 10706 - protein, 459 aa, Arabidopsis thaliana
MVVQNVQDLDVLPKHSSDSFDDDGRPKRTGTVWTASAHIITAVIGSGVLSLAWAVAQIGWIGGPVAMLLFSFVTFYTSTLLCSCYRSGDSVTGKRNYTYMDAIHSNLGGIKVKVCGVVQYVNLFGTAIGYTIASAISLVAIQRTSCQQMNGPNDPCHVNGNVYMIAFGIVQIIFSQIPDFDQLWWLSIVAAVMSFAYSAIGLGLGVSKVVENKEIKGSLTGVTVGTVTLSGTVTSSQKIWRTFQSLGNIAFAYSYSMILIEIQDTVKSPPAEVNTMRKATFVSVAVTTVFYMLCGCVGYAAFGDNAPGNLLAHGGFRNPYWLLDIANLAIVIHLVGAYQVYCQPLFAFVEKEASRRFPESEFVTKEIKIQLFPGKPFNLNLFRLVWRTFFVMTTTLISMLMPFFNDVVGLLGAIGFWPLTVYFPVEMYIAQKNVPRWGTKWVCLQVLSVTCLFVSVAAA

SEQ ID NO: 10707 - protein, 223 aa, Zea mays
  misc_feature (223)..(223): Xaa can be any naturally occurring amino acid
  unsure (1)..(223): unsure at all Xaa locations
NISRMILFPLPTTEKPVQANIKQARPSFSSPLTLDASPPLLPHPSIAPSLRSALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEAX

SEQ ID NO: 10708 - protein, 502 aa, Zea mays
  misc_feature (502)..(502): Xaa can be any naturally occurring amino acid
  unsure (1)..(502): unsure at all Xaa locations
QDTTHLLLPRLVSIATTLFSCGPPPSHSHPLASASTAAAAMQSLLLPTAAVAPVAAPCGRRNLPGRLSVRASATAVAAPRRETDPKKRVVITGMGLVSVFGNDVDAYYDRLLVGESGIGLIDRFDASKFPTRFAGQIRGFSSEGYIDGKNDRRLDDCLRYCIVSGKKALEASGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAMKRDAPIIAEYLGGAVNCDAYHMTDPRSDGLGVSSCIKQSLKDAGVAPEEVNYINAHATSTLAGDLAEVNAIKQVFKDPSGIKINATKSMIGHCLGAAGGLEAIATIKAITTGWVHPSINQFNPEEAVEFDTVPNVKKQHEVNVGISNSFGFGGHNSVVVFAPFKPX

SEQ ID NO: 10709 - protein, 334 aa, Glycine max; identical to SEQ ID NO: 10624
  misc_feature (334)..(334): Xaa can be any naturally occurring amino acid
  unsure (1)..(334): unsure at all Xaa locations

SEQ ID NO: 10710 - protein, 531 aa, Glycine max
VAECFDKIRVNPGNFADRRAQFETLEYTEEDYQKELEHIEKVFTPLVEKCKKYGRAMRIGTNHGSLSDRIMSYYGDSPRGMVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMIASELQKGVEPFEEKHRHYFDFQRRSGQLPVQKEGEEVDYRGVLHRDGSVLMSVSLDQLKMPEVLYKSLAAKLIVGMPFKDLATVDSILLREVPPVDDADARLALKRLIDISMGVITPLSEQLTKPLPNAMVLVNLKEISSRAYKLLPQGTRLVVSVRGDEPYEELDILKGIDATMLLHDLPYTEDKISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGRWLMQTLGMWEALPGRLTSMLGR

SEQ ID NO: 10711 - protein, 694 aa, Glycine max; identical to SEQ ID NO: 10371
  misc_feature (694)..(694): Xaa can be any naturally occurring amino acid
  unsure (1)..(694): unsure at all Xaa locations

SEQ ID NO: 10712 - protein, 291 aa, Glycine max
DWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENALWTPSKLIARLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHCDATIAFPLLVAETFASR

SEQ ID NO: 10713 - protein, 291 aa, Glycine max; identical to SEQ ID NO: 10712

SEQ ID NO: 10714 - protein, 162 aa, Glycine max
  misc_feature (162)..(162): Xaa can be any naturally occurring amino acid
  unsure (1)..(162): unsure at all Xaa locations
SGNRSYHHFSNLEPSRSCRSLGHTSSMAGRGKTLGSSAAKKATSRSSKAGLQFPVGRIARFLKAGKYAERVGAGAPVYLAAVLEYLAAEVLELAGNAARDNKKTRIVPRHIQLAVRNDEELSKLLGDVTIANGGVMPNIHNLLLPKKAGGSSKGAAADDDSX

SEQ ID NO: 10715 - protein, 137 aa, Zea mays
SRQPEVLWAQRSEKIFLTISLPDAKDVVLKTDPKGLFNFSAVVHGEPFSFTLELFDSILSEGSKTKTKMGLRNIICSIQKEKKGWWKRLLKSEEKHPYIKVDWNKWCDEDEESEFSGDSDGGFDEANEGDESDDDDG

SEQ ID NO: 10716 - protein, 354 aa, Zea mays
  misc_feature (354)..(354): Xaa can be any naturally occurring amino acid
  unsure (1)..(354): unsure at all Xaa locations
MGDAAAAAASTSAPTTPTSILICLEDGSDLLADADDGAGTDLVVAHDERLLVVDQDEEYVALLLSKESASGGCGPVEEMEDWMKAARSGCVRWIIKTTAMFRFGGKTAYVAVNYLDRFLAQRRVNREHAWGLQLLMVACMSLATKLEEHHAPRLSELPLDACEFAFDRASVLRMELLVLGTLEWRMVAVTPFPYISCFAARFRQDERRAVLVRAVECVFAAIRAMSSVEYQPSTIAVASILVARGRETPAGNLDALKAILGSSFPQLDTGHVYSCYSAMIREDDKSPTQSTSTSTSTGVASSGVSVAAHAGGSGSPSPGASVSVGANNAAGTAPPATTDKRNKRRRLRSPQRQX

SEQ ID NO: 10717 - protein, 157 aa, Zea mays; identical to SEQ ID NO: 9994

SEQ ID NO: 10718 - protein, 392 aa, Zea mays
  misc_feature (392)..(392): Xaa can be any naturally occurring amino acid
  unsure (1)..(392): unsure at all Xaa locations
MGSGGANTAPLLTPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRVFLANPDLPRRFEVDAPLNKYNRDTFYIPDPVIGYLTTHFFRQMYKCSLFSNLLFRLCSNWLVYQX

SEQ ID NO: 10719 - protein, 243 aa, Zea mays
  misc_feature (243)..(243): Xaa can be any naturally occurring amino acid
  unsure (1)..(243): unsure at all Xaa locations
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKAVCMEKYRKKDEDGRDTLSDIDVEREEECGICMEMNSKVVLPNCTHAMCIRCYQDWSSRSQSCPFCRDNLKKTCPSDLWIYVEDQDVVDMETVSSENLRRLFMYISKLPLIVPDVIFSVYDSHIKX

SEQ ID NO: 10720 - protein, 428 aa, Zea mays
  misc_feature (428)..(428): Xaa can be any naturally occurring amino acid
  unsure (1)..(428): unsure at all Xaa locations
SPSYSWLLATLCFRSAFSAPRFPLQLQSMASTDRSTPAEDEQQQKRPSLFSPYQMPRFRLAHRVVLAPMTRCRAPDAVPGPALAEYYAQRSTEGGLLISEGTIISPSGPGFPRVPGIYNQEQTDAWRKVVDAVHAKGAIFFCQLWHVGRASHQVYQAGAAAPISSTDKPISSRWRILMPDGSYGKYPTPRRLATSEIPEIVEQYRQAAINAIKAGFDGIEIHGAHGYLIDQFLKGGINDRTDEYGGSLSNRCRFLLEVTRAVVSAIGADRVAVRVSPAIDHLDAYDSNPLQLGLAVVERLNALQQEAGRLAYLHVTQPRYTAYGQTESGQHGSAEEESRLMRAVRGAYRGTFMCSGGYTRELGVEAIESGDADLVSYGRLFIANPDLVERFRRDAPLNKYVRKTFYTPDPVVGYTDYTFLGQPKARMX

SEQ ID NO: 10721 - protein, 475 aa, Zea mays
  misc_feature (475)..(475): Xaa can be any naturally occurring amino acid
  unsure (1)..(475): unsure at all Xaa locations
DISVAERLNRKSSMTSSIPKLLLLLFFLSHRSPIARAGDDGSYKVLSMGSPRTDSVCSQSKAVPSSSAGAATVPLHHRHGPCSPLPTKKMPTLEETLHRDQLRAAYIQRKFSGGGGAGGDVQRSDATVPTALGTSLNTLEYLITVGLGSPATSQTMLIDTGSDVSWVQCKPCSQCHSQADPLFDPSSSSTYSPFSCGSADCAQLGQEGNGCSSSSQCQYIVTYGDGSSTTGTYSSDTLALGSSAVRSFQFGCSNVESGFNDQTDGLMGLGGGAQSLVSQTAGTLGRAFSYCLPPTPSSSGFLTLGAAGGSGTSGFVKTPMLRSSQVPTFYGVRLQAIRVGGRQLSIPASVFSAGTVMDSGTVITRLPPTAYSALSSAFKAGMKQYPPAQPSGILDTCFDFSGQSSVSIPSVALVFSGGAVVSLDASGIILSNCLAFAGNSDDSSLGIIGNVQQRTFEVLYDVGRGVVGFRAGACX

SEQ ID NO: 10722 - protein, 324 aa, Zea mays
  misc_feature (324)..(324): Xaa can be any naturally occurring amino acid
  unsure (1)..(324): unsure at all Xaa locations
MGVLEDLVARAGGCAVIDGGFATQLEALGADINDPLWSAACLITRPHLVKEVHMQYLEAGADVIISSSYQATIPGFIARGMSVAEAEDLLRTSVKLANEARDEFWKSTLRKSKPIYNRALVAASIGSYGAYLADGSEYSGSYGADITAEKLKDFHRRRLQVLASAGPDLIAFEAIPNQMEAQALVELLEEEKVQIPSWICFSSVDGKNLCSGESFADCLKILNASEKVAVVGVNCTPPQFIEGIICEFRKQTKKAIAVYPNSGEVWDGRAKRWLPVECLGHKSFDALAKRWQEAGASLIGGCCRTTPSTIRAVSKILKGRTGHX

SEQ ID NO: 10723 - protein, 486 aa, Arabidopsis thaliana
  misc_feature (486)..(486): Xaa can be any naturally occurring amino acid
  unsure (1)..(486): unsure at all Xaa locations
MKSFNTEGHNHSTAESGDAYTVSDPTKNVDEDGREKRTGTWLTASAHIITAVIGSGVLSLAWAIAQLGWIAGTSILLIFSFITYFTSTMLADCYRAPDPVTGKRNYTYMDVVRSYLGGRKVQLCGVAQYGNLIGVTVGYTITASISLVAVGKSNCFHDKGHTADCTISNYPYMAVFGIIQVILSQIPNFHKLSFLSIMAAVMSFTYATIGIGLAIATVAGGKVGKTSMTGTAVGVDVTAAQKIWRSFQAVGDIAFAYAYATVLIEIQDTLRSSPAENKAMKRASLVGVSTTTFFYILCGCIGYAAFGNNAPGDFLTDFGFFEPFWLIDFANACIAVHLIGAYQVFAQPIFQFVEKKCNRNYPDNKFITSEYSVNVPFLGKFNISLFRLVWRTAYVVITTVVAMIFPFFNAILGLIGAASFWPLTVYFPVEMHIAQTKIKKYSARWIALKTMCYVCLIVSLLAAAGSIAGLISSVKTYKPFRTMHEX

SEQ ID NO: 10724 - protein, 394 aa, Zea mays
  misc_feature (394)..(394): Xaa can be any naturally occurring amino acid
  unsure (1)..(394): unsure at all Xaa locations
VRPAEGKPQQINRPITRSFGAQLVKNVQANAAIKNAAILPARHAPRQERKAPAKQPPPEDVIVLSSDSEQSRTQLESSASSVRSRKKVINTLSSVLSARSKAACGITDKRRQVVVIEDIDKLDVNNELAVVEYIEDIYTFYKIAQHDRRPCDYIDTQVEINPKMRAILAGWIIEVHHKFELMPETLYLTMYIIDQYLSLQPVLRRELQLVGVSAMLIACKYEEIWAPEVNDFILISDSAYSREQILSMEKGILNSLEWNLTVPTVYMFLVRFLKAATLGNKVEKEMENMVFFFAELALMQYGLVTRLPSLVAASVVYAARLTLKRAPLWTDTLKHHTGFRESEAELIECTKMLVSAHSSSAADSKLRAVYKKYSSEQFGGVALRPPAAAVEIKX

SEQ ID NO: 10725 - protein, 195 aa, Zea mays
  misc_feature (195)..(195): Xaa can be any naturally occurring amino acid
  unsure (1)..(195): unsure at all Xaa locations
MVMVSGGGGNAWAKEMTLRRRIASIFNKTQEHFPTLKDYNDYLEEVEDMTFNLIEGIDVEEIEAKIARYQQENAEQIYLSRAKRAEDLAAALKASRMNPVKAEANDTAAGSSQGISGGAGVQGQYAPAAVFGGVAQPRPTGMAPQLIGSGSDPLQGDDEETRRLRAERAARAGGWTAELSKRRALEEAFSAIFIX

SEQ ID NO: 10726 - protein, 350 aa, Zea mays
  misc_feature (350)..(350): Xaa can be any naturally occurring amino acid
  unsure (1)..(350): unsure at all Xaa locations
MGDAAASTSAPTTPTSILICLEDGSDLLADADDGAGTDLVVARDERLLVVDQDEEYVALLLSKESASGGGGPVEEMEDWMKAARSGCVRWIIKTTAMFRFGGKTAYVAVNYLDRFLAQRRVNREHAWGLQLLMVACMSLATKLEEHHAPRLSEFPLDACEFAFDRASVLRMELLVLGTLEWRMVAVTPFPYISCFAARFRQDERRAVLVRAVECVFAAIRAMSSVEYQPSTIAVASILVARGRETPAGNLDALKAILGSSFPQLDTGHVYSCYSAMIREDDKSPTQSTSTSTGVASSGVSVAAHAGGSGSPSPPGASVSVGANNAAGTAPPATTDNRNKRRRLRSPQRQX

SEQ ID NO: 10727 - protein, 192 aa, Zea mays
  misc_feature (192)..(192): Xaa can be any naturally occurring amino acid
  unsure (1)..(192): unsure at all Xaa locations
CCASRFTVRHKHTTRATAADLRPAVPMSSSGPLLATGTHHTGRQPEVLWAQRSEKIFLTISLPDAKDVVLKTDPKGLFNFSAVVHGEPFSFTLELFDSILSEGSKTKTKMGLRNIICSIQKEKKGWWKRLLKSEEKHPYIKVDWNKWCDEDEESEFSGDSDGGFDEANEGDESDDDDGMLYLPDLEKLRGKX

SEQ ID NO: 10728 - protein, 596 aa, Zea mays
  misc_feature (596)..(596): Xaa can be any naturally occurring amino acid
  unsure (1)..(596): unsure at all Xaa locations
LAGTMGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSFLETLNFFLTDLRASPEYLTLLVRNCQRLKTLKISECFMPDLVSLFRTAQTLQEFAGGSFEEQGQPVASRNYENYYFPPSLHHLSLLYMGTNDMQILFPYATALKKLDLQFTFLSTEDHCQIVQRCSNLETLEVRDVIGDRGLQVVAQTCKKLHRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLEVRGCLFSEHALALAALQLKSLRYLWVQGFRSSPTGTDIMAMVRPFWNIEYIVPDQDEPCPEHKRQILAYYSLAGRRTDCPPSVTLLYPAFX

SEQ ID NO: 10729 - protein, 200 aa, Zea mays
  misc_feature (200)..(200): Xaa can be any naturally occurring amino acid
  unsure (1)..(200): unsure at all Xaa locations
QVLSAHRSAPASSHARTAHRYLFSPLPSHSPGQSRPGMASPSSSPSRKALSKIACSRLQKELAEWQVNPPAGFKHRVTDDLQRWVIDVAGAAGTLYTGETYKLQVDFPEHYPMEAPQVIFLHPAPMHPHIYSNGHICLDILYDSWSPAMTVSSICISILSMLSSSPEKQRPADNDRYVKNCRNGRSPKETRWWFHDDTVX

SEQ ID NO: 10730 - protein, 335 aa, Zea mays
  misc_feature (335)..(335): Xaa can be any naturally occurring amino acid
  unsure (1)..(335): unsure at all Xaa locations
PPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGCHKX

SEQ ID NO: 10731 - protein, 753 aa, Zea mays
  misc_feature (753)..(753): Xaa can be any naturally occurring amino acid
  unsure (1)..(753): unsure at all Xaa locations
MDSSGEELLKKIRELEVGQAQLKQEMSKLIPGAGERRRSQSVSPRRGVPVPPPPPAKAKAGAPGRRLSGGFEGGQRAWARGSASFPHSSPLQREGRAGAGDASTSARLPERQYSRVLQSMGQSVHILDLDGRIIYWNQSAENLFGYPASEALGQDALMLLVDSHDHNAVNNIFQRISMGESWTGKFPVKNKQGHRFSAVATNTPFYDEDGSLMGFICVSSDSRQLEQIFCKPPTSARSQSESSMTSCDGSCSNTSHRINSLNRSSFDSNLPLQSTLASKITNLATKVTNKVRSRVRTDENDDGGSGESHCLDRGAKEEPTSSGTSTPRGDAPHGPFATEENSPGKSTNPNSDESEGKVGLHKILGSKAEALLNKKGISWPWKGRENEGPDERNHVILPWLHGGQENGVNHQKVSDSSISPDAQGAEHNQPSKNEASGSWSSFNNNSTGSASSTGSTNSSALYKVDHEADCLDYEILWEDLVIGEQIGQGSCGTVYHALWYGSDVAVKVFSKQEYSEEVILTFRQEVSLMKKLRHPNILLFMGAVMSPQRLCIVSEFLPRGSLFRLLQRSATKLDVRRRVHMALDIVRGMNYLHHSSPPIIHRDLKSSNLLVDKNWIVKVADFGLSRLKRETFLTTKTGKGTPQWMAPEVLRNEPSDEKSDVYSYGVILWELVTQKIPWENLNSMQVIGAVGFMNQRLDIPSEVDPQWKSIILSCWESDPQQRPSFQELLERLRELQRHYAIQHRNTKNSIEEX

SEQ ID NO: 10732 - protein, 241 aa, Zea mays
  misc_feature (241)..(241): Xaa can be any naturally occurring amino acid
  unsure (1)..(241): unsure at all Xaa locations
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEENKVLQKELAEKQKDQRQQVQRDQTQQQTSSSSTSFMLREAAPTTNVSIFPVAAGGRVVEGAAAQPQARVGLPPWMLSHLSCX

SEQ ID NO: 10733 - protein, 235 aa, Zea mays
  misc_feature (235)..(235): Xaa can be any naturally occurring amino acid
  unsure (1)..(235): unsure at all Xaa locations
SKKLFQAARSLVLSASHRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 10734 - protein, 479 aa, Zea mays
PTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNMLFVLGFNAFGGFSVFLPFLVAKVGGAPALRERLRDEVRRAMVGKGKDGEFGFATVREGMPLVRSTVYEMLRMQPPVPLQFGRARRDFVLRSHGGAAYQVSAGEVLCGYQPLAMRDPEVFERPEEFVPERFLGDDGARLLQHLFWSNGPETAQPGPGNKQCAAKEVVVDTACMLLAELFRRYDDFEVEGTSFTKLVK

SEQ ID NO: 10735 - protein, 195 aa, Zea mays
  misc_feature (195)..(195): Xaa can be any naturally occurring amino acid
  unsure (1)..(195): unsure at all Xaa locations
MVMVSGGGGNAWAKEMTLRRRIASIFNKTQEHFPTLKDYNDYLEEVEDMTFNLIEGIDVEEIEAKIARYQQENAEQIYLSRAKRAEDLAAALKASRMNPVKAEANDTAAGSSQGISGGAGVQGQYAPAAVLGGVAQPRPTGMAPQLIGSGSDPLQGDDEETRRLRAERAARAGGWTAELSKRRALEEAFSAIFIX

SEQ ID NO: 10736 - protein, 397 aa, Zea mays
  misc_feature (80)..(80): Xaa can be any naturally occurring amino acid
  misc_feature (111)..(111): Xaa can be any naturally occurring amino acid
  misc_feature (124)..(124): Xaa can be any naturally occurring amino acid
  misc_feature (128)..(128): Xaa can be any naturally occurring amino acid
  misc_feature (130)..(130): Xaa can be any naturally occurring amino acid
  misc_feature (136)..(136): Xaa can be any naturally occurring amino acid
  misc_feature (157)..(157): Xaa can be any naturally occurring amino acid
  misc_feature (162)..(162): Xaa can be any naturally occurring amino acid
  misc_feature (169)..(169): Xaa can be any naturally occurring amino acid
  misc_feature (177)..(177): Xaa can be any naturally occurring amino acid
  misc_feature (200)..(200): Xaa can be any naturally occurring amino acid
  misc_feature (207)..(207): Xaa can be any naturally occurring amino acid
  misc_feature (226)..(226): Xaa can be any naturally occurring amino acid
  misc_feature (255)..(255): Xaa can be any naturally occurring amino acid
  misc_feature (260)..(260): Xaa can be any naturally occurring amino acid
  misc_feature (292)..(292): Xaa can be any naturally occurring amino acid
  misc_feature (298)..(299): Xaa can be any naturally occurring amino acid
  misc_feature (323)..(323): Xaa can be any naturally occurring amino acid
  misc_feature (345)..(345): Xaa can be any naturally occurring amino acid
  misc_feature (379)..(379): Xaa can be any naturally occurring amino acid
  misc_feature (385)..(385): Xaa can be any naturally occurring amino acid
  unsure (1)..(397): unsure at all Xaa locations
PRVRPAKGWTRFAYGRPSSPCGPARPAREIIFYHHVVPYNEMVKDEFAFLAKGPKVLPCITIRNSSNGNPPIVGYHIDHXILLLMLRGNSCSLNLKHMILQPSGGQYHLLXMHFTDFPGHILSXEQHXAXSQFPFXLSRACLIYHLCSSLVCWRQWXLPFSXISILLDXTSYSTLRXTRLTSQLFHWHLGNTPLQLGLQXFRSLPLXALALDGLLDHNLCFGLFSXALFLGLHIQSICRTFDGRDLLLLQHCAYXQSVQXLFSWPFFSTFRLLFSGDRQCFLGHYYLQLDLXRSSLLXXHYSRIYLTSKETAYSGSDPSASGXGKRRSFGSALACLRWPTALRYXWELPLPVCGAKQQPSLAIPYLPRSYGAARDRWTXRAKPQXRPSTCSSGSCST

SEQ ID NO: 10737 - protein, 149 aa, Zea mays; identical to SEQ ID NO: 5266

SEQ ID NO: 10738 - protein, 476 aa, Zea mays
  misc_feature (476)..(476): Xaa can be any naturally occurring amino acid
  unsure (1)..(476): unsure at all Xaa locations
RYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVCX

SEQ ID NO: 10739 - protein, 394 aa, Zea mays
  misc_feature (394)..(394): Xaa can be any naturally occurring amino acid
  unsure (1)..(394): unsure at all Xaa locations
VVFKAIDTKTGNTVAVKRIRIGKDKKEGVNFTALREIKLLKELKDPNIIELIDCFPYKENLHLVFEFMETDLEALIKDKNIILSPADTKSYVQMMLKGLAFCHKKWVLHRDMKPNNLLIGADGQLKLADFGLARVFGSPGRNFTYQVFARWYRAPELLFGSKQYGSGVDIWAAGCIFAELLTRRAFLQGSSDIDQLGKIFAALGTPKSSQWPDMVYLPDYVEYQYVAAPPLRTLFPMASDDALDLLSKMLTYDPKARISAQQALEHRYFSSLPAPTRPSQLPRPRRKGDQGNNKIPDLNLQDGPMVLSPPRKLRRVTAHEGMEGMHRTDKVDEHPSGMRHTDDMPSQSSRIPMSVDVGAVFGTRPAPRPTLNSADKSRLKRKLDMDPEFGYAEX

SEQ ID NO: 10740 - protein, 219 aa, Zea mays
SYAYILIEIQDTIKAPPPSEVTVMKKATMVSVATTTVFYMLCGCMGYAAFGDDAPDNLLTGFGFYEPFWLLDVANAAIVVHLVGAYQVFCQPLFAFVEKRAAARWPDSRFMTRELRLGPFVLGVFRLTWRTAFVCLTTVVAMMLPFFGDVVGLLGAVSFWPLSVYFPVEMYKAQRRVRRWSTRWLCLQTLSAVCLLVSIAGAVGSTAGVINAVNLHRPF

SEQ ID NO: 10741 - protein, 272 aa, Zea mays
  misc_feature (272)..(272): Xaa can be any naturally occurring amino acid
  unsure (1)..(272): unsure at all Xaa locations
PEELLPHGSSLPWEGFHYITNRVMDSSLIDSENSMPGCACSHPECSPENCGHVSLFDGVYNSLVDINGTPMHGRFAYDEDSKIILQEGYPIYECNSSCICDSSCQNKVLQKGLLVRLELFRSENKGWAIRAAEPILQGTFVCEYIGEVVKADKAMKNAESVSSKGGCSYLFSIASQIDRERVRTVGAIEYFIDATRSGNVSRYISHSCSPNLSTRLVLVESKDCQLAHIGLFANQDIAVGEELAYDYRQKLVAGDGCPCHCGTTNCRGRVYX

SEQ ID NO: 10742 - protein, 244 aa, Zea mays
  misc_feature (244)..(244): Xaa can be any naturally occurring amino acid
  unsure (1)..(244): unsure at all Xaa locations
QHRKHNSVPTMAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPQQFLPFNQLAALNSAAYLQQQQLLPFSQLADVSPAAFLTQQQLLPFYLHAMPNAGTLLQLQQLLPFNQLALTNSTVFYQQPIIGGALFX

SEQ ID NO: 10743 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPTAFYQQPIIGGALFX

SEQ ID NO: 10744 - protein, 240 aa, Zea mays
  misc_feature (240)..(240): Xaa can be any naturally occurring amino acid
  unsure (1)..(240): unsure at all Xaa locations
HNSVPTMAAKIFCFLMLLGLSASAATATIFPQCSQAPIASFLPPYLSPAVSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPVAFLTQQQLLPFYLHAAPNAGTLLQLQQLLPFNQLALTNPTAFYQQPIIGGALFX

SEQ ID NO: 10745 - protein, 195 aa, Zea mays
MASHQDKASYQAGETKARTEEKTGQAVGATKDTAQHAKDRAADAAGHAAGKGQDAKEATKQKASDTGGYLGKKTDEAKHKAGETTEATKQKASETTEATKQKAGETTEAARQKAADAMEAAKQKAAEAGQYAKDTAVSGKDKSSGVIQQATEQVKSAAAGAKDAVMSTLGMGGDDKQGDANTNTNKDSSTITRDH

SEQ ID NO: 10746 - protein, 178 aa, Zea mays
  misc_feature (178)..(178): Xaa can be any naturally occurring amino acid
  unsure (1)..(178): unsure at all Xaa locations
ISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10747 - protein, 358 aa, Zea mays
  misc_feature (358)..(358): Xaa can be any naturally occurring amino acid
  unsure (1)..(358): unsure at all Xaa locations
PRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACEX

SEQ ID NO: 10748 - protein, 116 aa, Zea mays
AAAAVLAAALLLLAAGAGTASAAVSCGEVTSSVAPCLGYAMGSAASPSAACCSGVRSLNSRASSAADRQATCNCLKSMTGRLGGGVSMANAANIPGKCGVSVGVPISPTVDCTKIN

SEQ ID NO: 10749 - protein, 116 aa, Zea mays; identical to SEQ ID NO: 10748

SEQ ID NO: 10750 - protein, 116 aa, Zea mays; identical to SEQ ID NO: 10748

SEQ ID NO: 10751 - protein, 285 aa, Zea mays; identical to SEQ ID NO: 10633
  misc_feature (285)..(285): Xaa can be any naturally occurring amino acid
  unsure (1)..(285): unsure at all Xaa locations

SEQ ID NO: 10752 - protein, 606 aa, Glycine max; identical to SEQ ID NO: 10087
  misc_feature (606)..(606): Xaa can be any naturally occurring amino acid
  unsure (1)..(606): unsure at all Xaa locations

SEQ ID NO: 10753 - protein, 460 aa, Glycine max
  misc_feature (460)..(460): Xaa can be any naturally occurring amino acid
  unsure (1)..(460): unsure at all Xaa locations
TTTTHSLQISIASLSMATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPYX

SEQ ID NO: 10754 - protein, 492 aa, Zea mays
  misc_feature (492)..(492): Xaa can be any naturally occurring amino acid
  unsure (1)..(492): unsure at all Xaa locations
MAPSPPRRAALLLTTVLLLAAAGSTPGATAAGIFQVRRKFTAGVGGGAGANISALRAHDGTRHGRLLAAADLPLGGLGLPTDTGLYYTEIKLGTPPKHYYVQVDTGSDILWVNCITCEQCPHKSGLGLDLTLYDPKASSTGSMVMCDQAFCAATFGGKLPKCGANVPCEYSVTYGDGSSTIGSFVTDALQFDQVTRDGQTQPANASVIFGCGAQQGGDLGSSNQALDGILGFGEANTSMLSQLTTAGKVKKIFAHCLDTIKGGGIFSIGDVVQPKVKTTPLVADKPHYNVNLKTIDVGGTTLQLPAHIFEPGEKKGTIIDSGTTLTYLPELVFKEVMLAVFNKHQDITFHDVQGFLCFQYPGSVDDGFPTITFHFEDDLALHVYPHEYFFANGNDVYCVGFQNGASQSKDGKDIVLMGDLVLSNKLVIYDLENRVIGWTDYNCSSSIKIKDDKTGATSTVNSHDLSSGWKFHWHMSPVLLLVTTVCSYLICX

SEQ ID NO: 10755 - protein, 241 aa, Zea mays
  misc_feature (241)..(241): Xaa can be any naturally occurring amino acid
  unsure (1)..(241): unsure at all Xaa locations
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMPCAINASCAALAFAGIPMKHLAVAISCGVMDNGVVILDTSRAEEQQARSFAHLVFPNSRKSVESKDPTQRDEESERGLITCITHGAMSEDDYFNCIERGVMASSRISDFMRKTLQKEASRDAX

SEQ ID NO: 10756 - protein, 205 aa, Zea mays
  misc_feature (205)..(205): Xaa can be any naturally occurring amino acid
  unsure (1)..(205): unsure at all Xaa locations
PPPPASSEGHTASGRAARSPFPNMSTTEDERSGAAAEAGGGEEERRERSVGLMAGLVDRAKGFVVEKVAQIPKPEAALDRVSFQSISREGVELHSHVDVSNPYSHRIPICEITYTFKSAGKVIASGMMPDPGWIAASGSTKLELPVKVPYDFILTLMKDLGGDWDIDYLLEVGLTIDLPVIGAFTIPLTTEGEIKLPTFRDLLFX

SEQ ID NO: 10757 - protein, 165 aa, Zea mays
MDGRMFGLETPLMVALQHLLDVPDGDAGAGGDKASGAAAGGGPTRTYVRDARAMAATPADVKELPGAYAFVVDMPGLGTGDIRVQVEDERVLVISGERRREEREDAKYLRMERRMGKFMRKFVLPDNADMDKISAVCRDGVLTVTVEKLPPPEPKKPKTIEVKVA

SEQ ID NO: 10758 - protein, 273 aa, Zea mays
  misc_feature (273)..(273): Xaa can be any naturally occurring amino acid
  unsure (1)..(273): unsure at all Xaa locations
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDLRKRSGRRPSTTRARGSKAGFTCLEASTX

SEQ ID NO: 10759 - protein, 116 aa, Zea mays; identical to SEQ ID NO: 10748

SEQ ID NO: 10760 - protein, 300 aa, Zea mays
  misc_feature (300)..(300): Xaa can be any naturally occurring amino acid
  unsure (1)..(300): unsure at all Xaa locations
MMRETYMDVLPPVDHIAARSNWFPAAARLWTAAENKQFERALAGLDLCRPDWEEVARAIPGRTVREVVSHFKHLEVDVQQIESGQVPLPAYGGGASSFTLQWDGYGPGPGDFRHGYRFAGGCGRRHHGRTPEQERKKGVPWTEEEHRLFLLGLKKYGKGDWRNISRNFVQTRTPTQVASHAQKYFIRLNSGGKDKRRSSIHDITTVNLTDDQPPSPSQSSLITSQSNAPAPAPGPAPAAGICQVPLAADAKRHGARTLPFSSPNRTSAAPAYRMEFHDQQGLQCGPLHDQLLASQSVLFX

SEQ ID NO: 10761 - protein, 581 aa, Zea mays; identical to SEQ ID NO: 10245
  misc_feature (581)..(581): Xaa can be any naturally occurring amino acid
  unsure (1)..(581): unsure at all Xaa locations

SEQ ID NO: 10762 - protein, 233 aa, Zea mays; identical to SEQ ID NO: 10634

SEQ ID NO: 10763 - protein, 185 aa, Zea mays
  misc_feature (185)..(185): Xaa can be any naturally occurring amino acid
  unsure (1)..(185): unsure at all Xaa locations
MAMATQGQADQQQQHGRSEPTTSVAANRWGPYSGAGDFASNMAVILAALLAALALGLALNAAVRYLLRRSRRAGSVGGQGNGSGVLMPSDDPAEKPSVEVELQAPPPALLVYSAAGTTLAGAAAECAICLAEFADGDAVRVMPACGHGFHARCIERWLAEGRRSSCPTCRAPAVQRSLHASELLX

SEQ ID NO: 10764 - protein, 220 aa, Zea mays
  misc_feature (220)..(220): Xaa can be any naturally occurring amino acid
  unsure (1)..(220): unsure at all Xaa locations
KNPRSPQPAAAHAAACTSGVKMSRHPEVKWAQRIDKVYITVQLPDAKDAKVNLEPDGVFTFSGSVGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMGGMGGMGMDDFEDDSDEEEVSKPQAAGHAAEAEKTESAEAKTESAQSSX

SEQ ID NO: 10765 - protein, 116 aa, Zea mays; identical to SEQ ID NO: 10748

SEQ ID NO: 10766 - protein, 235 aa, Zea mays
  misc_feature (235)..(235): Xaa can be any naturally occurring amino acid
  unsure (1)..(235): unsure at all Xaa locations
MSRLAAAALRCVVTASRDTSSSRFAVSAPVSARLFSADASGEAAATAAESQDDSFFKASREGLAYGRFYSVIGGGSRLEKNILKTDIIHHLDRCGLSLDDVKIEYNKGYAPLAALLRFSSKAMFTTAIRQANQNRLHRIDEISRETWDLKKSFDGKAVLLQGVPRNALADDIERFLCGTNFEPPPFETFLRAGVPEPIRMMLVKFHTKTDAMNAFITKNRSFCLNSQVSMRVLQX

SEQ ID NO: 10767 - protein, 401 aa, Zea mays
  misc_feature (401)..(401): Xaa can be any naturally occurring amino acid
  unsure (1)..(401): unsure at all Xaa locations
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDEX

SEQ ID NO: 10768 - protein, 270 aa, Zea mays
  misc_feature (270)..(270): Xaa can be any naturally occurring amino acid
  unsure (1)..(270): unsure at all Xaa locations
RIRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDEX

SEQ ID NO: 10769 - protein, 268 aa, Zea mays
  misc_feature (268)..(268): Xaa can be any naturally occurring amino acid
  unsure (1)..(268): unsure at all Xaa locations
EISSSTSRAVTVPNSVSSPSPPYKPNANTTPVTSRSPAMAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIKNIHEEMLYLREREEEMQDVNRRTNSRMAWLGFLSLGVCLSVAGLQLWHLKTFFERKKLLX

SEQ ID NO: 10770 - protein, 370 aa, Zea mays
  misc_feature (370)..(370): Xaa can be any naturally occurring amino acid
  unsure (1)..(370): unsure at all Xaa locations
PSPWSGLLSKRAALLQTEPYPSTSARRWQQEMVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIALEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHVVSGDSLIECATIADKCAKVGAVGINCTPPRFIHGLILSIRKVTDKPILIYPNSGERYDGEKKEWVESTGVSDGDFVSYVNEWCKDGAALIGGCCRTTPNTIRAIHRTLNQGCHKHQLPVAX

SEQ ID NO: 10771 - protein, 191 aa, Zea mays
  misc_feature (191)..(191): Xaa can be any naturally occurring amino acid
  unsure (1)..(191): unsure at all Xaa locations
GFSPSLAFVSASRLSSRSRFPSPRTQAPTMTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTVX

SEQ ID NO: 10772 - protein, 378 aa, Zea mays; identical to SEQ ID NO: 10138
  misc_feature (378)..(378): Xaa can be any naturally occurring amino acid
  unsure (1)..(378): unsure at all Xaa locations

SEQ ID NO: 10773 - protein, 235 aa, Glycine max
  misc_feature (235)..(235): Xaa can be any naturally occurring amino acid
  unsure (1)..(235): unsure at all Xaa locations
VEFMEKVSASAESEELTVEERNLLSVAYKNVIGARRASWRIISSIEQKEESRGNEDHVAVIRDYRSKIEAELSNICDGILKLLDTRLVPSAASGDSKVFYLKMKGDYHRYLAEFKTGADRKEAAESTLSAYKAAQDIANTELPPTHPIRLGLALNFSVFYYEILNSPDRACSLAKQAFDEAIAELDTLGEESYKDSTLIMQLLRDNLTLWTSDMQDDGADEIKEAAPKGDGEQNX

SEQ ID NO: 10774 - protein, 172 aa, Zea mays
  misc_feature (172)..(172): Xaa can be any naturally occurring amino acid
  unsure (1)..(172): unsure at all Xaa locations
PNAAEPLAPPVSSASQHTAASPSDRCSLGFPAAMAGKGGKGLLAAKTTAAKSTDKDKDRKKAPVSRSSRAGLQFPVGRIHRQLKSRASAHGRVGATAAVYSAAILEYLTAEVLELAGNASKDLKVKRITPRHLQLAIRGDEELDTLIKGTIAGGGVIPHIHKSLINKTAKEX

SEQ ID NO: 10775 - protein, 171 aa, Zea mays
  misc_feature (171)..(171): Xaa can be any naturally occurring amino acid
  unsure (1)..(171): unsure at all Xaa locations
PPVPSCSPMAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKALX

SEQ ID NO: 10776 - protein, 376 aa, Glycine max
  misc_feature (376)..(376): Xaa can be any naturally occurring amino acid
  unsure (1)..(376): unsure at all Xaa locations
RRRQKGKKDEVERRWEWQREDYKEMGRWVNCRGNIFPFLGMVMAMLAQSGSMVVIKVAMTDGINKYVMVVYSLALSTILLLPFALFLHRSERPPLTFSALCSFFLLAFFGSSGQIMAYVGIDLSSPTLASAMLNLIPAFTFILALIFRMEEVHWKHSSSQAKFLGTIVSIAGAFVVILYKGPPIFKTHLSNSSNKFLFSQQLNWILGGMFCAGDSIVCSLWYIYQASVAYKYPAVTTIVFFQLLFSTIQCGVFALIVVQDQTEWELKLDIGLIGIVYQAIAATLIRYILCTWCVLKAGPLFCSMFKPVAIIFSVFMGAIFLGDDLSLGSLIGAVIIVIGFYAVLWGKSIEDNKIEKGVENLESSCHNVPLLQNRTX

SEQ ID NO: 10777 - protein, 412 aa, Zea mays
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGSTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPK

SEQ ID NO: 10778 - protein, 252 aa, Zea mays
  misc_feature (252)..(252): Xaa can be any naturally occurring amino acid
  unsure (1)..(252): unsure at all Xaa locations
GTLASSSLNPPHHTMSGSASRKLFQTARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPETAKDEIALWFEPKELVSYTSNAEKWVYGVNX

SEQ ID NO: 10779 - protein, 763 aa, Zea mays
  misc_feature (50)..(50): Xaa can be any naturally occurring amino acid
  misc_feature (118)..(118): Xaa can be any naturally occurring amino acid
  misc_feature (173)..(173): Xaa can be any naturally occurring amino acid
  misc_feature (288)..(288): Xaa can be any naturally occurring amino acid
  misc_feature (351)..(351): Xaa can be any naturally occurring amino acid
  misc_feature (366)..(366): Xaa can be any naturally occurring amino acid
  misc_feature (383)..(384): Xaa can be any naturally occurring amino acid
  misc_feature (390)..(390): Xaa can be any naturally occurring amino acid
  misc_feature (428)..(428): Xaa can be any naturally occurring amino acid
  misc_feature (502)..(502): Xaa can be any naturally occurring amino acid
  misc_feature (530)..(530): Xaa can be any naturally occurring amino acid
  misc_feature (577)..(577): Xaa can be any naturally occurring amino acid
  misc_feature (591)..(591): Xaa can be any naturally occurring amino acid
  misc_feature (604)..(604): Xaa can be any naturally occurring amino acid
  misc_feature (606)..(606): Xaa can be any naturally occurring amino acid
  misc_feature (614)..(614): Xaa can be any naturally occurring amino acid
  misc_feature (630)..(630): Xaa can be any naturally occurring amino acid
  misc_feature (643)..(643): Xaa can be any naturally occurring amino acid
  misc_feature (654)..(654): Xaa can be any naturally occurring amino acid
  misc_feature (663)..(663): Xaa can be any naturally occurring amino acid
  misc_feature (732)..(732): Xaa can be any naturally occurring amino acid
  misc_feature (741)..(741): Xaa can be any naturally occurring amino acid
  unsure (1)..(763): unsure at all Xaa locations
LASVRPCLVIRVRSPPWRSSRRSPPRCSSPSPPSSASPSPSCSGWSCRAXSSPRPRPAAAAARPATPTPSSRRRRGSTTTTSSSSAPRSRTPSPKEQHRFFSPSTNMLVSSWLSSLLXSSSSLVRLRDSARRASPAHIARTSTASLRCSLHSLALCPSCLAPSPLWSLVSLAXRLPHMRMPELPWKLGRVLARLLSLLSALALLWVSCLHQVGLWFCTSQLMYLSCITVMTGRVFLSPSLAMVLVGRPWLSSEELVEVSTQRLLMLVPILLERSRGTFLRMILGTQLXLLIMLVTMLVTLLEWDLISLGHTQSLLVLPLLLRLFHLSESTMISLGCATHSLLALLVSLSAXSPPFLLLISLKSRLXKKLSLHLRSSSSSPPSXXLLVLLXSAGWPFQLSSPSTTSVLRRRFPTGVCSSVFQLVCGLVXLLVLSQNTTLAMHTVLCKMLRIRAELVLPLMSFLVLLLDTSRLSSRFSLLLLASMSVSPLLRCTALQLPLLVCXAQSQLVLLLMLMVPSVTMLVVLLRWLEXATESVRELMLLMLLATQLLLLERGLPLVQLLLCPWRFLVPLSAELEXRSSTSSPPRFSLVXLLEPCFRTGSLPXPXRVLEAPPXRWWRRSAGSSTPFLGXWREQPSPTTQPVXRSPLMLPSRRXFLRALWSCXLPSSLEPSSASRLSPAFLLVPLFLECRSPSLLPTPAVHGTTPRSTSRLVPASTRGPLAPRGLTATRPLXSVTPSVTPXRTPPARPSTSSSSSWPWSPSCL

SEQ ID NO: 10780 - protein, 289 aa, Zea mays
  misc_feature (289)..(289): Xaa can be any naturally occurring amino acid
  unsure (1)..(289): unsure at all Xaa locations
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRSX

SEQ ID NO: 10781 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 10782 - protein, 382 aa, Zea mays; identical to SEQ ID NO: 10686

SEQ ID NO: 10783 - protein, 347 aa, Glycine max
  misc_feature (347)..(347): Xaa can be any naturally occurring amino acid
  unsure (1)..(347): unsure at all Xaa locations
MGKGGSLSDGVVKKIVLSYSYVAIWIFLSFTVIVYNKYILDKKMYNWPFPISLTMIHMSFCATLALLLVRVFRLVEPVSMSRDVYLSSVVPIGALYSLSLWLSNSAYIYLSVSFIQMLKALMPVAVYSIGVMLRKESYKNDTMLNMLSISLGVGVAAYGEARFDAWGVLLQLGAVAFEATRLVMIQILLTSKGISLNPITSLYYVAPCCLVFLSIPWIFVEYPVLRDTSSFHFDFVIFGTNSFCAFALNLAVFLLVGKTSALTMNVAGVVKDWLLIAFSWSVIKDTVTPINLFGYGLAFLGVAYYNHSKLQALKAKEAQKKTAQADEEEGRLLEDRDDNKRNEQQTX

SEQ ID NO: 10784 - protein, 182 aa, Zea mays
  misc_feature (182)..(182): Xaa can be any naturally occurring amino acid
  unsure (1)..(182): unsure at all Xaa locations
KHTTRATAADLRPAVPMSSSGPLLATGTHHTGRQPEVLWAQRSEKIFLTISLPDAKDVVLKTDPKGLFNFSAVVHGEPFSFTLELFDSILSEGSKTKTKMGLRNIICSIQKEKKGWWKRLLKSEEKHPYIKVDWNKWCDEDEESEFSGDSDGGFDEANEGDESDDDDGMLYLPDLEKLRGKX

SEQ ID NO: 10785 - protein, 195 aa, Zea mays; identical to SEQ ID NO: 10725
  misc_feature (195)..(195): Xaa can be any naturally occurring amino acid
  unsure (1)..(195): unsure at all Xaa locations

SEQ ID NO: 10786 - protein, 334 aa, Zea mays; identical to SEQ ID NO: 10230

SEQ ID NO: 10787 - protein, 615 aa, Zea mays
  misc_feature (615)..(615): Xaa can be any naturally occurring amino acid
  unsure (1)..(615): unsure at all Xaa locations
MTKSDLVNNLGTIARSGTKEFMEALAAGADVSMIGQFGVGFYSAYLVAERVVVTTKHNDDEQYVWESQAGGSFTVARDTSGEQLGRGTKMTLYLKDDQLEYLEERRLKDLIKKHSEFISYPISLWIEKTTEKEISDDEDEEDKKDEEGKVEDVDDEKEEKEKKKKKIKEVSHEWQLVNKQKPIWMRKPEEITKEEYAAFYKSLTNDWEEHLAVKHFSVEGQLEFKAVLFVPKRAPFDLFDTRKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSTNRTKIAELLRYHSTKSGDELTSLKDYVTRMKEGQNDIFYITGESKKAVENSPFLEKLKKRGYEVLFMVDAIDEYSIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEEAPEADTDMPPLEDDAGESKMEEVDX

SEQ ID NO: 10788 - protein, 515 aa, Zea mays
  misc_feature (515)..(515): Xaa can be any naturally occurring amino acid
  unsure (1)..(515): unsure at all Xaa locations
MASPRGRMSFPLRSFLMICLMAQLGASNVVLMANNTTLSFDDVEAIFTPAVKGSGVNGVLYAVEPMDACSPLRTKAIGGSVSTFALVIRGGCHFDDKVRNAQNAGFKAAVVYDTEDNGILVSMAGSSSGVHIYAVFVSKASGEELKKYSGQTDAELWIIPTYANSAWSIMAISFISLLVMSAILAACFFARRHQIRRDRARLPQTREFHGMNSRLVKAMPSLIFTKVQEDDCTSATCAICLEDYSAGEKIRVLPCRHKFHAACVDLWLTSWRTFCPVCKRDANAGTPEPPVSESTPLLSSSAIRLPEPTASVSFRSTVAAAAAASPPRPISRHPSPSRSISRKHSVSGSSIPGTPIPRFHASSSSPTCTSGSSLDLANMPSSPWPRASHLASAHSSCGGRLSPPIHIRNTSAAHVSRSAYGSPSRYVGSSHMSRGSPSCYYLGSSSGQQHPYLRHCTLSGTSLFTMVPQSPQQNQLQHGGDSEKDLSAAAPFRQLYYLQHCPDSGTSSQSLPGCX

SEQ ID NO: 10789 - protein, 381 aa, Zea mays
  misc_feature (381)..(381): Xaa can be any naturally occurring amino acid
  unsure (1)..(381): unsure at all Xaa locations
RVRRQPVTHSHSLDRSRPSAPSASPQGEEAMAAGGNGAGGDTRAAFARIYKTLKEELLTDPAFEFTEESRQWIDRMVDYNVLGGKCNRGLSVVDSYKLLKGADALGEEETFLACTLGWCIEWLQAFFLVLDDIMDDSHTRRGQPCWFRVPQVGLIAANDGIILRNHISRILRCHFKGKPYYADLLDLFNEVEFKTASGQLLDLITTHEGEKDLTKYNITVHGRIVQYKTAYYSFYLPVACALLLSGENLDNYGDVENILVEMGTYFQVQDDYLDCYGDPEFIGKIGTDIEDYKCSWLVVQALERADESQKRILFENYGKKDPACVAKVKNLYKELDLEAVFQEYENESYKKLIADIEAQPSIAVQKVLKSFLHKIYKRQKX

SEQ ID NO: 10790 - protein, 147 aa, Zea mays
  misc_feature (147)..(147): Xaa can be any naturally occurring amino acid
  unsure (1)..(147): unsure at all Xaa locations
TFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 10791 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10792 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPKCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALFX

SEQ ID NO: 10793 - protein, 553 aa, Zea mays
  misc_feature (553)..(553): Xaa can be any naturally occurring amino acid
  unsure (1)..(553): unsure at all Xaa locations
ASPFSLVLQVATHSVRRDRRSETTSPPTIRNARAMCPVRGGGCSWPASVVGSVTAALLLAAVIVRLFVPRACSSGIIKGRRQVGAGAAGGARLPAGSLGWPLLGETLAFIRAAYSPRPESFVEKRRVLYGKVFKSHLWGSPAVVSSDPEVSRAVLQADASAFVPWYPRSLMELMGQSSILVLGGGLQRRVHGLAGAFFKSPQLKAQVTLDMQRRVGRAMDMWGRRHRSMGDDDSGGMPVRVQNEAKSIVFEILVRALIGLEEGDKMQYLRQQFQEFIAGLISLPVKLPGTQLYRSLKAKKRMTKLIKTIIQEKRKKMMSEGDEDLRGGTHPRDMIDVLLGNGNDELSDELISDNMIDFMIPAEDSVPVLITLAVKYLSECPLALQQLEEENMELKRQKSGAGETLEWTDYMSLAFTQHVITETLRMGNIINGIMRKAVRDVEVRGHLVPKGWRVLVYFRAVHLDAAVHDDPHAFNPWRWKERPDVVAMSGFTPFGGGQRLCPGLDLARLEASIFLHHLVTNFRWVAEEDTVVNFPTVRLKRGMPIAVTPRTCX

SEQ ID NO: 10794 - protein, 324 aa, Zea mays
  misc_feature (19)..(19): Xaa can be any naturally occurring amino acid
  misc_feature (50)..(51): Xaa can be any naturally occurring amino acid
  misc_feature (92)..(92): Xaa can be any naturally occurring amino acid
  misc_feature (98)..(98): Xaa can be any naturally occurring amino acid
  misc_feature (200)..(200): Xaa can be any naturally occurring amino acid
  misc_feature (285)..(285): Xaa can be any naturally occurring amino acid
  misc_feature (319)..(319): Xaa can be any naturally occurring amino acid
  unsure (1)..(324): unsure at all Xaa locations
ALFFFFFLPIVSPVISNNXNSAPTVRYIQLHSCNSRADGSCISVLNLKQXXETRLCTTRRKAAMIQGHAQALHSGRLFCGPKGCSVFSSTIXHSAAAXVTHSPVAQPPRALQALAISSAPTSAGASGASLQLPYLQLLASAPSSPAFQRHPWIQTPILTPNQTLTPTPETMRLSLSSSESWMDQQPHQYSLASPLSCLPXCTHCHPISCYQYGCLGTCSCNKIPRQDHLRHHRIGTAGGETLLLPEPLPEPLRSEVQTKLPSEGGKHSPQTGSHVSSRRESGARXGIRMDACTVDREGSPCRMPTSKYRSHSRRGRNPXRGPSP

SEQ ID NO: 10795 - protein, 235 aa, Zea mays
  misc_feature (235)..(235): Xaa can be any naturally occurring amino acid
  unsure (1)..(235): unsure at all Xaa locations
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALFX

SEQ ID NO: 10796 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10797 - protein, 149 aa, Zea mays; identical to SEQ ID NO: 5266

SEQ ID NO: 10798 - protein, 245 aa, Zea mays
  misc_feature (245)..(245): Xaa can be any naturally occurring amino acid
  unsure (1)..(245): unsure at all Xaa locations
QHRKHNSVPTMAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLGSLNSASYLQQQQLPFSQLPAAYPQQFLPFNQLAALNSPAYLQQQQLLPFSQLAGVSPATFLTQPQLLPFYQHVAPNAGTLLQLQQLLPFNQLALTNPAVFYQQPIIGGALFX

SEQ ID NO: 10799 - protein, 249 aa, Zea mays; identical to SEQ ID NO: 9907

SEQ ID NO: 10800 - protein, 248 aa, Zea mays
  misc_feature (248)..(248): Xaa can be any naturally occurring amino acid
  unsure (1)..(248): unsure at all Xaa locations
MSSAVEAISCPKVDVPAGPEPGEPAKEAAPPAEHCDTAPNGKCAPRCHGEEEEEEEDEEDEEKAPKAIDLGPMVSIKEQLEKDKDDESLRRWKEQLLGGVDLNSVGETLEPDVKIMSLSILSPGRPDIVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTSX

SEQ ID NO: 10801 - protein, 494 aa, Arabidopsis thaliana
  misc_feature (494)..(494): Xaa can be any naturally occurring amino acid
  unsure (1)..(494): unsure at all Xaa locations
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLSVACLVISVVAGVGSIAGVMLDLKVYKPFKSTYX

SEQ ID NO: 10802 - protein, 247 aa, Zea mays
SCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVA

SEQ ID NO: 10803 - protein, 700 aa, Zea mays
  misc_feature (700)..(700): Xaa can be any naturally occurring amino acid
  unsure (1)..(700): unsure at all Xaa locations
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKEDQLEYLEERRLKDLVKKHSEFISYPISLWTEKTTEKEISDDEDEEEKKDAEEGKVEDVDEEKEEKEKKKKKIKEVSHEWSLINKQKPIWMRKPEEITKEEYAAFYKSLTNDWEEHLAVKHFSVEGQLEFKAVLFVPKRAPFDLFDTRKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRGRIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKIIKEVLGDKVEKVVVSDRVVDSPCCLVTGEYGWTANMERIMKAQALRDSSMSGYMSSKKTMEINPENPIMDELRKRAEADKNDKSVKDLVMLLFETALLTSGFSLDDPNTFGTRIHRMLKLGLSIDEDESAEAEAEMPPLEDDAGESKMEEVDX

SEQ ID NO: 10804 - protein, 334 aa, Zea mays; identical to SEQ ID NO: 10230

SEQ ID NO: 10805 - protein, 703 aa, Zea mays
  misc_feature (703)..(703): Xaa can be any naturally occurring amino acid
  unsure (1)..(703): unsure at all Xaa locations
EGRLDMASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWIEKTTEKEISDDEDEEDKKDEEGKVEDVDEKEEKEKKKKKIKEVSHEWQLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPDNAIMEELRKRAEADKNDKSVKDLVMLLFETALLTSGFSLDDPNTFGGRIHRMLKLGLSIDEDEAPEADTDMPPLEDDAGESKMEEVDX

SEQ ID NO: 10806 - protein, 455 aa, Zea mays
  misc_feature (455)..(455): Xaa can be any naturally occurring amino acid
  unsure (1)..(455): unsure at all Xaa locations
PNSHLAPRIVLSTHLQLRNPTPPAMSSSGAPAPAAAMAVDDAEDDQLASMSTEDIIRASRLLDNEIRVLKDELQRTNLELESFKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIVQVQAKKKSSLNYYAX

SEQ ID NO: 10807 - protein, 290 aa, Zea mays
  misc_feature (290)..(290): Xaa can be any naturally occurring amino acid
  unsure (1)..(290): unsure at all Xaa locations
MAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAKX

SEQ ID NO: 10808 - protein, 720 aa, Zea mays
  misc_feature (720)..(720): Xaa can be any naturally occurring amino acid
  unsure (1)..(720): unsure at all Xaa locations
AESIAALARIDTVKQRMEAAYTTLQDAAGLAQLSQSVEDVFSSGNLPKAAETLATMRHCLSAVGEVAEFANVRKQLEVLEERLDEMVQPRLVDALSNRKVDAVQDLRGILIRINRFKSLEVQYTKIHVKPLKKLWDDFELKQRSSKVDMEKLSGESISGLSFSSWLPNFYDETLLYLEQEWKWCLTAFPDEYKSLVPKVLTETMSELNSSFVSRINIATGDVIPETRSIAKGILDVLSGDLPKSTKLQNKHLQALIELHNMTGTFARNIQYLFSESDLAVVLNTLKAIYSPYETFKARYGQMERAILSAEMTSIDIRGAVPRGVGAQGIELSETVRRMEESIPEMIVLLEAAVERCISLTGGSEADELVLALDDVMLQYISNLQETLKSLRIICGLDSDALKKDAGLEKKEVQRLVDVSEEEEWSIVQGALQILTVADCLTSRTSVFEASLRATLARIGTNFSVSGFGSSLDKSPAATADENADLSFAGRAALDIAAIRLSDLPDKSKKFLTVLEQSKDPRFHALPLTSQRVAAFSDTVNELVYDVLISKVRQRLSEVARLPIWSSVEEQGGLPLPSFSAYPQAYVTSVGEYLLTLPQQLEPLAEGISGNEAGNDEAQFFATEWIFKVAEGATALFMEQLRGIHYITDRGSQQLAADIEYLNNVLSALSMPIPPFLSTFHACVSTPRDQVRDLIKSDGASQLDLPTTHLVCKIRRITLDX

SEQ ID NO: 10809 - protein, 777 aa, Zea mays
  misc_feature (777)..(777): Xaa can be any naturally occurring amino acid
  unsure (1)..(777): unsure at all Xaa locations
NSLHRLEACAAMAVLGTAAVEVLIPVAALVGIAFALLQWYVVARVPVPSHAGEDGGGGGNKNVREEEEHVEEDGMDYLLVEARCAEIQRAISVGATSFLLTEYKYLAVFTAAFAVVIFVFLGSAQRFSARPGPCAYDPSRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAVGLLVCAITTVVATDVTEVKGSDEVGPALKRQILISTVLMTAGIAAVTFLGLPPSFTLFDFGNDKHVKNWHLFICVSAGLWAGLVIGYVTEYFTSNAYGPVQAVARSCRTGAATNVIFGLAVGYKSVIVPIMAIAAAIYASFRLAAMYGIALAALGMLSTIATGLAIDAYGPISDNAGGIAEMAGMPHRVRERTDALDAAGNTTAAIGKGFAIGSAALVSLALFGAYVSRAGITAVDVLSPRVFVGLLLGAMLPYWFSAMTMRSVGSAALRMVEEVRRQFDTIPGLAEGLAVPDYATCVRISTDASLKKMMAPGALVMFSPLVAGTLFGVETLAGLLAGALVSGVQVAISASNSGGAWDNAKKYIEAGLSEEARSLGPKGSEAHKAAVIGDTIGDPLKDTSGPSLNILIKLMAVESLVFAPFFAAHGGIIFDHLX

SEQ ID NO: 10810 - protein, 288 aa, Zea mays
  misc_feature (288)..(288): Xaa can be any naturally occurring amino acid
  unsure (1)..(288): unsure at all Xaa locations
MVGLSEGEKHFIRGGIAQDVRTDGRRRLQFRSLSVQTGVIPQANGSARVRLGATEIIASVKAELGKPSILHPDKGKVAIFVDCSPTAEPLFEGRGSEELSAELSVSLQRCLLGGKSGAGAAIDLSSLIVVDGKVCWDLYIDGLVVSSDGNLLDALAVAIKVALSDTGIPKVNVSVSAASDEEPEVDVSDEEFLQFDTSGVPVIITLTKVGRHYIVDATSEEESQMSSAVSVSVNRHGQICGLTKRGGAGLDPSVIFDMISVAKHVSQQFISLLDSEIAAAEAEEEAQX

SEQ ID NO: 10811 - protein, 707 aa, Glycine max
  misc_feature (707)..(707): Xaa can be any naturally occurring amino acid
  unsure (1)..(707): unsure at all Xaa locations
SMKSSARKRVSIIRNSNPGQDIAELQPASPGSPLLVPRQKYCESLHKPIRRKTSTVMVGNVAIGSEHPIRIQTMTTTDTKDVAGTVEQVMRIADKGADIVRITVQGKKEADACFEIKNTLVQKNYNIPLVADIHFAPSVALRVAECFDKIRVNPGNFADRRAQFETLEYTEEDYQKELEHIEKVFTPLVEKCKKYGRAMRIGTNHGSLSDRIMSYYGDSPRGMVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMRASELQKGVEPFEEKHRHYFDFQRRSGQLPVQKEGEEVDYRGALHRDGSVLMSVSLDQLKMPEVLYKSLAAKLIVGMPFKDLATVDSILLRELPPVDDADARLALKRLIDISMGVITPLTEQLTKPLPNAMVLVNLKEISTGAYKLLPQGTRLVVSVRGDEPYEELDILKGVDATMLLHDLPYTEDRISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEEX

SEQ ID NO: 10812 - protein, 371 aa, Glycine max
  misc_feature (371)..(371): Xaa can be any naturally occurring amino acid
  unsure (1)..(371): unsure at all Xaa locations
IILSDSELCGLETPLSPNRTMKELGLVSMMLMAELLDVIVNTLSKAAMKKGMNDFVFIMYSNAFAACLLLLLALFFYRKRTLPPLSCNTLGLFLVVGMLSCINQSIKFFGIGYSSPTLASALSDLVPAFTFILAVIFRMEKLDWKANSTLAKSIGTVVSIAGALLLSLYKGQVIINNNPPFKLFPQKLVSSMQFDWVFGALLLAAHSCFLSINYILLTRIVREYPAELVVVLSRIALTSILSVPAALISVKDLKALRLGFNMELIAIGCSAIFVLSFRGVIHIWIMGKRGPVYVAMFKPLEIVFAVILGVTFLGDSLYIGSVIGAAIIVVGFYAVIWGKSQEKVEEDCTVCSSESYDNEVPLLQNKRTGEX

SEQ ID NO: 10813 - protein, 363 aa, Glycine max
  misc_feature (363)..(363): Xaa can be any naturally occurring amino acid
  unsure (1)..(363): unsure at all Xaa locations
MEVMCGAKVGNMVHKAKPYVLTVGLQFGMAGTYLFTMASLNHGMSRLVFIVYRNAIAALALAPFALIFERKVRPKMTWTVFIQILVLGFLEPVVDQGFTFLGMQYTSASFASAVMNAVPSVTFVLAVIFRLEHIKIRELRSQAKVIGTLVTFAGALLMTLYKGPQFDLFHHSNTTHQQGGSHTQNHSHWVAGTLFICLGCLAWSSFYILQSITVKRYPAELSLSSLICLAGALQSAVVALIADHNPRAWAIGFDYSLYGPLYTGIMSSGIAYYIQGLVMQSRGPVFVTSFNPLCMIIVTALGSFLLGEHLYLGSIIGGIIIAVGLYSVVWGKGKDYKDDTSSPATTKETETMQLPITLPNNKX

SEQ ID NO: 10814 - protein, 422 aa, Glycine max
  misc_feature (422)..(422): Xaa can be any naturally occurring amino acid
  unsure (1)..(422): unsure at all Xaa locations
TLPTQLTPTMASWWCSSPSATLTVSTTTTRHFSLLSHTSQFRIQTLTFPPSSFTRFTTAPPSLRFRVPCSNKTAFETELPEDGVDCVGTGQDVECLVNTEEKQSEPSSSSSSSSSSSSMLCLAEALWEGAVLVSPFFFWGTAMVAMKEVLPKCGPFFVSAFRLIPAGFLLVAFAASRGRTLPSGFNAWLSITLFALVDAACFQGFLAEGLQRTSAGLGSVIIDSQPLTVAVLAALLFGESIGVVGAAGLVLGVIGLVLLELPALSFDESNFSLWGSGEWWMLLAAQSMAIGTVMVRWVSKYSDPVMATGWHMVIGGLPLVLFAVLNNDPAVSLSLKEYSSTDILALLYTSIFGSAVSYGVFFYSATKGSLTKLSSLTFLTPMFASIFGFLYLGETFSPVQLVGALVTVAGIYMVNFRSTSEX

SEQ ID NO: 10815 - protein, 330 aa, Glycine max
  misc_feature (330)..(330): Xaa can be any naturally occurring amino acid
  unsure (1)..(330): unsure at all Xaa locations
MATFEQFWSRKTLLGLALGQFLSLLITSTGFTSSLLAKKGINAPTSQSFLNYVFLAIVYGIIVLYRREALKAKWYYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKNADRVELMAMLGLFGGIISAIQISILERNELKSIHWSAGAVLPFVGFAVAMFMFYSLVPVLLKINGSTMLNLSLLTSDMWAVLIRIFAYHEKVDWMYYVAFGAVVVGLIIYSGGDGDENQDPHHVAEDASQRQHDEEATSGKSX

SEQ ID NO: 10816 - protein, 100 aa, Glycine max
GIFNKFLSSAIYAWGIHLKGPVYVAMFKPLSIVIAVAMGVMFLGDSLYVGSIIGATIISIGFYTVMWGKATEQKEEEGEEENVGSQESSITENVPLLQSY

SEQ ID NO: 10817 - protein, 372 aa, Glycine max
  misc_feature (372)..(372): Xaa can be any naturally occurring amino acid
  unsure (1)..(372): unsure at all Xaa locations
MAKRVFLYKDLVPFGAMVTMECLNVALNTLFKAATLRGMSYHVFVVYAYAVAAIVLIPGPFISQRCRSRVLPPLSFPLLRKIGLLGLIGCASQIVGYTGISFSSPTLSSAISNLVPAFTFLLAIIFRMEKVIVRNTTCQAKVLGTIVSITGAFVVTFYKGPPIIIVHTPSLSLHQPINTLNSVDRSWAIGGLLLTAEYILVPLWYIVQVQIMKVYPNELTVIFFYNLCVSIMAAIVAIFTETNAGAWKIGLDTALASIVCSGIFGSFVNNAVHTWVLRIKGPVYVAMFKPLSIAIAVALGVMFLGDTLHLGSLVGATVISIGFYTVMWGKATEENVDEDVPGQQSPPTTENVPLLQSYKTDTAEKKMHGSVX

SEQ ID NO: 10818 - protein, 232 aa, Zea mays
  misc_feature (232)..(232): Xaa can be any naturally occurring amino acid
  unsure (1)..(232): unsure at all Xaa locations
LRVNSLGYLLHELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQX

SEQ ID NO: 10819 - protein, 367 aa, Zea mays
  misc_feature (367)..(367): Xaa can be any naturally occurring amino acid
  unsure (1)..(367): unsure at all Xaa locations
PLPPLPLNTTGIPMAKYGEGDKRWIVEERADGTNVHNWHWAERDCIEWSRARLSSLLAGLTVLDGEDGLTLRTVALDNLDGEAYVNIRKGKVIPGYELSLTLSWEAEAASESGAVKVAGTAEVPYLADENADEDPDLHITVRGDETPLALRAKDAFLSRGKPMVLEKIREFVAAMAKGGPAKDELDSKKTPAKVAAAAPGAAPAKKEEVVAPAPAAGKKKAKGKDKEGFKTIKMTETFYCRSKDIYEILMDENRWKGFTQSNAKISREVGGEFSLFDGCITGVNEDLQEGKLIAQKWRFGSWPDGLYSSVRLMLDEPESGVTVIKLKQTGVPEEDKYGNSTVVENTERGWRDLIFQRIRGMFGFGIX

SEQ ID NO: 10820 - protein, 378 aa, Zea mays
  misc_feature (378)..(378): Xaa can be any naturally occurring amino acid
  unsure (1)..(378): unsure at all Xaa locations
TKPRADPNEPEPFQTLSSPPLPPKHHRAPMAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIREFVAAMAKGGPAKDELDSKKTPTKVAGSAPAKEAVLAPAPAVEKKKAKGKDKEGFKTIEMTEKFYCRSKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGIX

SEQ ID NO: 10821 - protein, 540 aa, Zea mays
  misc_feature (540)..(540): Xaa can be any naturally occurring amino acid
  unsure (1)..(540): unsure at all Xaa locations
RRCRILTLVRSSAAPNPSLRRGPPPLPRPTMSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPTEFFRDTTCX

SEQ ID NO: 10822 - protein, 244 aa, Zea mays; identical to SEQ ID NO: 10437
  misc_feature (244)..(244): Xaa can be any naturally occurring amino acid
  unsure (1)..(244): unsure at all Xaa locations

SEQ ID NO: 10823 - protein, 349 aa, Zea mays
  misc_feature (349)..(349): Xaa can be any naturally occurring amino acid
  unsure (1)..(349): unsure at all Xaa locations
MAPPAHDRLRRLVLLLVVATAAAALLLAPTTADAALPRVQHTPTKADGSLAILVVGDWGRRGQFNQTLVAQQMGVVGQKLDIDFVISTGDNIYDDGIANTSDPLFKESFSNIYTANSLQKPWYLVLGNHDYTGNALAQLDPAIRKVDSRYTAIAKSFIVNSGVADFFLVDTTPFIVHYWNNTKFDWRGVAPRDTYIANLLKDLKCALTASKAPWKIVVGHHPISSACGHGNNTELEELLLPVLRTHGVDMYLNGHDHCLQRVSSRDSRLQLLTSGGGSKAWAGKFKPTLDKVEFLYDGQGFMSMRLSRTEARLAFFDVAGSVLHCWTMHAQKLKTTTTTTAAAAAAGHX

SEQ ID NO: 10824 - protein, 184 aa, Zea mays
  misc_feature (184)..(184): Xaa can be any naturally occurring amino acid
  unsure (1)..(184): unsure at all Xaa locations
PFLSSPVRPSPLPRQPRRGMASPSSSSFPSRKALSKIACRRLQKELTEWQVNPPAGFEHRVTDNLQRWVVDVAGAPGTLYTGETYKLQVDFSEHYPMEAPQVIFLHPAPMHPHIYSNGHICLDILYDSWSPAMTVSSICISILSMLSSSPAKQRPADNDRYVRNCRNGRSPKETTWWFHDDTVX

SEQ ID NO: 10825 - protein, 469 aa, Zea mays; identical to SEQ ID NO: 10187

SEQ ID NO: 10826 - protein, 484 aa, Zea mays
  misc_feature (484)..(484): Xaa can be any naturally occurring amino acid
  unsure (1)..(484): unsure at all Xaa locations
GGGAMPLYYGTPASCSGLSSVSLSTSMQGAMARVRAPFTPSQWIELEHQALIYKYLAANSPIPHSLLIPIRRSLAASPYPPSYFGTSTLGWGSFQLGYSGNADLEPGRCRRTDGKKWRCSRDAVADQKYCERHMNRGRHRSRKHVEGQPGHAAKAMSAVAAAAAAATQPAAMAGAGAPAAGLTVNQHQLTAKSYATGATDPCSLQYNRELVNKQNESENMQDSDNLSMLTSMNTGNTGSVFPFSKQNTNPFEVTSSRLEFGLVSSDSLMSSPHSSLENVNLLGSQSMNEHQNPASLQHFVDWPRTPAQGGLSWPEAEDMQAQRSQLSISAPMASSELSSASTSPIHEKLMLSPLKLSREYSPTGLGIAANRDEVSQLEATWATMFRDSSMGGPLGEVLAKNGNVEARNYLSAPLNLLTDYWDSSHGMESSPVGVLQKTTAFGSVSSSTGSSPRAENHGAYDGFGNLRDDLGSIVVRHPSIRLVX

SEQ ID NO: 10827 - protein, 622 aa, Zea mays; identical to SEQ ID NO: 10629
  misc_feature (622)..(622): Xaa can be any naturally occurring amino acid
  unsure (1)..(622): unsure at all Xaa locations

SEQ ID NO: 10828 - protein, 279 aa, Zea mays
  misc_feature (279)..(279): Xaa can be any naturally occurring amino acid
  unsure (1)..(279): unsure at all Xaa locations
MTMATKAACVLAVWVLVALGLCDLGSTRAPLGSKPQREFDYFALSLQWPGTICASTRHCCATNGCCRSEPLQTFTIHGLWPDYDDGTWPSCCRRTQFEMDKILPLKEVLDKYWPSLYCSKSGTCFSGKGLFWAHEWEKHGTCSAPVVQDELQYFTLALDLYSKYNVTEMLSSGGIQVSNGKEYALSDVIDTIKHAFGGSPQIVCKRGSIEELRLCFDKELKPRDCLTTSLANGSVSKSKHCPRYITLPTYDPLVLANSTVEIMTQFDEFEVPAALYTAX

SEQ ID NO: 10829 - protein, 111 aa, Zea mays
LRRKSSGFSRGASIYRGVTRHHQHGRWQARIGRVSGNKDLYLGTFSTQEEAAEAYDVAAIKFRGLSAVTNFDITRYDVDKIMESSTLLPGEQVRRRKEGADAAVSEAAAAL

SEQ ID NO: 10830 - protein, 315 aa, Zea mays
  misc_feature (33)..(33): Xaa can be any naturally occurring amino acid
  misc_feature (59)..(59): Xaa can be any naturally occurring amino acid
  misc_feature (79)..(79): Xaa can be any naturally occurring amino acid
  misc_feature (83)..(83): Xaa can be any naturally occurring amino acid
  misc_feature (99)..(99): Xaa can be any naturally occurring amino acid
  misc_feature (127)..(127): Xaa can be any naturally occurring amino acid
  misc_feature (130)..(130): Xaa can be any naturally occurring amino acid
  misc_feature (169)..(170): Xaa can be any naturally occurring amino acid
  misc_feature (177)..(177): Xaa can be any naturally occurring amino acid
  misc_feature (199)..(199): Xaa can be any naturally occurring amino acid
  misc_feature (228)..(229): Xaa can be any naturally occurring amino acid
  misc_feature (244)..(244): Xaa can be any naturally occurring amino acid
  misc_feature (302)..(302): Xaa can be any naturally occurring amino acid
  unsure (1)..(315): unsure at all Xaa locations
RPSDSRGCSPRSRPPGSRHPTSATPSTSSTRCXTGGCRMRSPARIVMKLNLTLNIEHLXSARYFWASPRTSCLLASGIXSVFXLSITWWMLLLQVLGVXRRISLNALHQLTEAIFLYLEHCCGQKDXTGXEICWCPMTTIASLRTGSCHSSTRCYRSNLLRMFGHRRRXXRALAKKXMMKAPIFIGHTRITSLYTAQHXLMDHLETCCSVMQFVILALLLTLYKIYGXXMGKPSMQHQGRQGLXFLVEAFQSIIYAMPICSAMVQIMLCILTRLKSLMVAILEHTPMKQSHGARLRVQQNLXRCIAMQVSLSRFL

SEQ ID NO: 10831 - protein, 242 aa, Zea mays
  misc_feature (242)..(242): Xaa can be any naturally occurring amino acid
  unsure (1)..(242): unsure at all Xaa locations
RRRKQTNLATQGERGQKGGESVVMASIVASRRAVPLVRALEKLIAASSAPGTGSALRPVAVAGGLRGYNTGAPLRRYEGAESEDDSVREYDGRHGGRDYAVPSLFSDIFRDPLSAPHSIGRLLNLVDDLAVAAPGRAVRRGWNAKEDEEALHLRVDMPGLGKEHVKVWAEQNSLVIKGEGEKEDSEDEAAPPPRYSGRIELAPEVYRMDKIKAEMKNGVLKVVVPKVKEQQRKDVFQVNVEX

SEQ ID NO: 10832 - protein, 640 aa, Zea mays
  misc_feature (640)..(640): Xaa can be any naturally occurring amino acid
  unsure (1)..(640): unsure at all Xaa locations
LNFPTFPFPFLLQSTASPHPVSTPYKSKRGRGGKQIGWRQSVAGLAGTMGGEAEGGERRLGRVLSFGIPDTALGLVMGYVEDPWDRDAISLVCRHWCRVDALSRKHVTVAMAYSTTPERLFRRFPCLESLKLKAKPRASMFNLISDDWGGSASPWIRQLSATFHFLKKLHLRRMIVSNEDINILVRAKAHMLVALKLDRCSGFSTPSIALVARSCRKLETLFLEESTIDEKENDEWIRELATSNSVLETLNFFLTDLRASPEYLTLLVRNCQRLKTLKISECFMPDLVSLFRTAQTLQEFAGGSFEEQGQPVASRNYENYYFPPSLHHLSLLYMGTNDMQILFPYATALKKLDLQFTFLSTEDHCQIVQRCSNLETLEVRDVIGDRGLQVVAQTCKKLHRLRVERGDDDQGGLEDEQGRISQVGLMAIAQGCPELTYWAIHVSDITNAALEAVGTCSKNLNDFRLVLLDREAHITELPLDNGVRALLRGCTKLRRFAFYVRPGALSDVGLGYVGEFSKSIRYMLLGNVGESDNGIIQLSKGCPSLQKLEVRGCLFSEHALALAALQLKSLRYLWVQGFRSSPTGTDIMAMVRPFWNIEYIVPDQDEPCPEHKRQILAYYSLAGRRTDCPPSVTLLYPAFX

SEQ ID NO: 10833 - protein, 467 aa, Arabidopsis thaliana
  misc_feature (467)..(467): Xaa can be any naturally occurring amino acid
  unsure (1)..(467): unsure at all Xaa locations
MDVPRPAFKCFDDDGRLKRSGTVWTASAHIITAVIGSGVLSLAWAIGQLGWIAGPTVMLLFSFVTYYSSTLLSDCYRTGDPVSGKRNYTYMDAVRSILGGFRFKICGLIQYLNLFGITVGYTIAASISMMAIKRSNCFHESGGKNPCHMSSNPYMIMFGVTEILLSQIKDFDQIWWLSIVAAIMSFTYSAIGLALGIIQVAANGVVKGSLTGISIGAVTQTQKIWRTFQALGDIAFAYSYSVVLIEIQDTVRSPPAESKTMKIATRISIAVTTTFYMLCGCMGYAAFGDKAPGNLLTGFGFYNPFWLLDVANAAIVIHLVGAYQVFAQPIFAFIEKQAAARFPDSDLVTKEYEIRIPGFRSPYKVNVFRAVYRSGFVVLTTVISMLMPFFNDVVGILGALGFWPLTVYFPVEMYIRQRKVERWSMKWVCLQMLSCGCLMITLVAGVGSIAGVMLDLKVYKPFKTTYX

SEQ ID NO: 10834 - protein, 268 aa, Zea mays
LSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVARELRVGPLALSVFRLTWRSAFVCATTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 10835 - protein, 425 aa, Zea mays
  misc_feature (5)..(5): Xaa can be any naturally occurring amino acid
  misc_feature (39)..(40): Xaa can be any naturally occurring amino acid
  misc_feature (103)..(103): Xaa can be any naturally occurring amino acid
  misc_feature (122)..(122): Xaa can be any naturally occurring amino acid
  misc_feature (137)..(138): Xaa can be any naturally occurring amino acid
  misc_feature (142)..(142): Xaa can be any naturally occurring amino acid
  misc_feature (172)..(172): Xaa can be any naturally occurring amino acid
  misc_feature (199)..(199): Xaa can be any naturally occurring amino acid
  misc_feature (207)..(207): Xaa can be any naturally occurring amino acid
  misc_feature (212)..(212): Xaa can be any naturally occurring amino acid
  misc_feature (218)..(218): Xaa can be any naturally occurring amino acid
  misc_feature (227)..(227): Xaa can be any naturally occurring amino acid
  misc_feature (229)..(229): Xaa can be any naturally occurring amino acid
  misc_feature (232)..(232): Xaa can be any naturally occurring amino acid
  misc_feature (248)..(248): Xaa can be any naturally occurring amino acid
  misc_feature (251)..(251): Xaa can be any naturally occurring amino acid
  misc_feature (263)..(263): Xaa can be any naturally occurring amino acid
  misc_feature (271)..(271): Xaa can be any naturally occurring amino acid
  misc_feature (273)..(273): Xaa can be any naturally occurring amino acid
  misc_feature (291)..(292): Xaa can be any naturally occurring amino acid
  misc_feature (308)..(308): Xaa can be any naturally occurring amino acid
  misc_feature (312)..(312): Xaa can be any naturally occurring amino acid
  misc_feature (328)..(328): Xaa can be any naturally occurring amino acid
  misc_feature (331)..(331): Xaa can be any naturally occurring amino acid
  misc_feature (346)..(346): Xaa can be any naturally occurring amino acid
  misc_feature (358)..(358): Xaa can be any naturally occurring amino acid
  misc_feature (379)..(379): Xaa can be any naturally occurring amino acid
  misc_feature (385)..(385): Xaa can be any naturally occurring amino acid
  unsure (1)..(425): unsure at all Xaa locations
QWRIXDLKTATKVLPWRESSLRRRRPTPTGEPSATSRTXXEAHTSTWRSARGLCQKNQLLLLLQMLKIKLALLDTVQSPGNSLQHWQPNLQLPFWTQLEVKDXKETLIRHFTHLQIWKAQKXQMTVPCLWCRRWMKXXVLNXKRSRWKILRRQHLILTVVMQEILWLWLTMXMKFTDFTGKLRVQAASLQIICQAKLIXMRRCVAFXLTGSXRYTTNXSCWRRPFSXPXTSXTDSWHVKMWCGRSFSXLVXLLCCSRASMKKXAYLWSRIXSXSVIVHTQGLTFLRWRGGXXTHLISICRCRLHTVSXEGFXRQHNQRRSSNSCLSSXSSXVLSNMRCSSSARLCXQPLPSTPLNAPXMGSSPGTNAVNCTQDIQKNIXWFALGXWLNCTKEQLMGNLQGSIESTTLLDIAMLRNRNPQLSCWMP

SEQ ID NO: 10836 - protein, 260 aa, Zea mays
  misc_feature (260)..(260): Xaa can be any naturally occurring amino acid
  unsure (1)..(260): unsure at all Xaa locations
RPIVPTRLRPYPSPFRPATPELPYLSSASHSPPTHSRKPHKNPRSPQPAAAHAAACTSGVKMSRHPEVKWAQRIDKVYITVQLPDAKDAKVNLEPDGVFTFSGSVGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMGGMGGMGMDDFEDDSDEEEVSKPQAAGHAAEAEKTESAEAKTESAQSSX

SEQ ID NO: 10837 - protein, 391 aa, Zea mays
  misc_feature (391)..(391): Xaa can be any naturally occurring amino acid
  unsure (1)..(391): unsure at all Xaa locations
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGGFPGGGMPGGFPGGVPGNVDMSKILNDPDLMAAFSDPEVMAALQDVMNNPANFAKHQANPKVGPIIAKMMAKFNGSQX

SEQ ID NO: 10838 - protein, 827 aa, Zea mays
  misc_feature (827)..(827): Xaa can be any naturally occurring amino acid
  unsure (1)..(827): unsure at all Xaa locations
SLVWAVAVRRRVKRDETTMRKWALSSALLLLFLLTTLPDPAKKLQVNAEESSDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLINNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPADEDETSEEEDSSPETTEEETEEDEEKEKKPKTKTIKETTSEWELLNDMKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKNEMEEKKGQYAKFWNEFGKSIKLGIIEDATNRNRLAKLLRFESTKSDGKLASLDEYISRMKPGQKDIFYLTGSSKDQLEKSPFLERLTKKNYEVIFFTDPMDEYLMQYLMDYEDRKFQNVSKEGLKLGKDSRLKDLKESFKELTEWWKKALESESVDSVKVSSRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDELX

SEQ ID NO: 10839 - protein, 828 aa, Zea mays
  misc_feature (828)..(828): Xaa can be any naturally occurring amino acid
  unsure (1)..(828): unsure at all Xaa locations
SSLVWAVAVRRRVKRDETTMRKWALSSALLLLFLLTTLPDPAKKLQVNAEESSDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLINNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPADEDETSEEEDSSPETTEEETEEDEEKEKKPKTKTIKETTSEWELLNDMKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKNEMEEKKGQYAKFWNEFGKSIKLGIIEDATNRNRLAKLLRFESTKSDGKLASLDEYISRMKPGQKDIFYLTGSSKDQLEKSPFLERLTKKNYEVIFFTDPMDEYLMQYLMDYEDRKFQNVSKEGLKLGKDSRLKDLKESFKELTEWWKKALESESVDSVKVSSRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDELX

SEQ ID NO: 10840 - protein, 622 aa, Zea mays
  misc_feature (622)..(622): Xaa can be any naturally occurring amino acid
  unsure (1)..(622): unsure at all Xaa locations
MSPNLDSAIKSQVPALLLRRLFGASRRDEAKQLQRTPAPVGRRRVFVQTETGCVLGMDLDRGDNAHTVKRRLQLALNMPTGGTSLTFGDRLLENDLSFIRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLEVMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKEALHESARAAVGQRMKQRLGTSCKFX

SEQ ID NO: 10841 - protein, 588 aa, Zea mays
  misc_feature (588)..(588): Xaa can be any naturally occurring amino acid
  unsure (1)..(588): unsure at all Xaa locations
AIGTLAMADEAKAKGNAAFSAGRFEEAARHFTDAIALAPDNHVLYSNRSAALASLHRYSDALADAQKTVDLKPDWAKGYSRLGAAHLGLGDAASAVAAYEKGLELDPSNEGLKAGLQDAKKAAAAPPRRGSSGPDAIGQMFQGPELWSKIASDPPTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAVETYQAGLKHDPNNQELLDGVKRCVEQINKANRGEISQDELQERQNKAMQDPEIQNILTDPIMRQVLIDFQENPSAAQEHLKNPGVMQKIQKLVSAGIVQMRX

SEQ ID NO: 10842 - protein, 260 aa, Zea mays
  misc_feature (260)..(260): Xaa can be any naturally occurring amino acid
  unsure (1)..(260): unsure at all Xaa locations
PALQATKFYSVHLRPSSSQETTRTSAIRPAMAAARRLSLPLVLLVVLAVAGRAAAQDYDFFYLVLQWPGAYCDTKQSCCYPKSGKPAADFGIHGLWPNRDDGTYPQNCSPDNAFNPSKVSDLLSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAFX

SEQ ID NO: 10843 - protein, 654 aa, Zea mays
  misc_feature (654)..(654): Xaa can be any naturally occurring amino acid
  unsure (1)..(654): unsure at all Xaa locations
EIRVSDKLLSESTPARTSAEVEMGRGADEVVKVVDSEDGEGEEEEAEAAAAEGSSKETPMLPRMPVRVLLAEGDDSTRHVISALLRKCGYRVAAASDGVKAWDILKEKSFNIDLVLTEVELPLMSGFLLLSTIMEHDASKNIPVIMMSSHDSVSMVFKCMLKGASDFLVKPLRKNELRNLWQHVWRKQLANGGPDVQHIQEENLAERMEQKTGVTKDDNLNSDGPCKNRECSEQESDAQSSCTRSELEAESKQTNNILEYMQSTERHLSIRSHKDLELNGETKTRTKGNNLIPTREDDLLPKKRTCLNDNNSERTSRDMELVHIMDNQQKHDTQRDVDTMRTTSRRNDEKNSIPAHQLELSLRRTDYGKLENHEKNDRRTLNHSTSSAFYLYNCRTASSLGNAGDGQLCSTSETLVDVENRNGDLAALSEDTTETNRPPIRVVPFPVPVQCFTFDGQPFWNGTPVASPFYPQSAPPIWNSKTPTWQESTPQATSLPQKSQQKEPVEMDAKPVENAEEQFVVGPPSASGKQLHVEIPKDDLRHISPVTGESGISTVLDSTRNTLSSSGCDSTSNQITAPTEPSSNVYRGVPETARAEGLRHLSQREAALNKFRLKRKDRCFEKKVRYQSRKLLAEQRPRVKGQFVRQDHSIQGSX

SEQ ID NO: 10844 - protein, 575 aa, Zea mays
  misc_feature (575)..(575): Xaa can be any naturally occurring amino acid
  unsure (1)..(575): unsure at all Xaa locations
MYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEHX

SEQ ID NO: 10845 - protein, 269 aa, Zea mays; identical to SEQ ID NO: 10272
  misc_feature (269)..(269): Xaa can be any naturally occurring amino acid
  unsure (1)..(269): unsure at all Xaa locations

SEQ ID NO: 10846 - protein, 581 aa, Zea mays
  misc_feature (581)..(581): Xaa can be any naturally occurring amino acid
  unsure (1)..(581): unsure at all Xaa locations
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESGIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGENDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEHX

SEQ ID NO: 10847 - protein, 167 aa, Zea mays
  misc_feature (167)..(167): Xaa can be any naturally occurring amino acid
  unsure (1)..(167): unsure at all Xaa locations
DKTRPSNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 10848 - protein, 236 aa, Zea mays
  misc_feature (236)..(236): Xaa can be any naturally occurring amino acid
  unsure (1)..(236): unsure at all Xaa locations
MVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQX

SEQ ID NO: 10849 - protein, 260 aa, Zea mays
  misc_feature (260)..(260): Xaa can be any naturally occurring amino acid
  unsure (1)..(260): unsure at all Xaa locations
RVNESLLSKLREGKLTVSLDPIFYPSSAMASRQQHPTSYHAGETKARAEEKTGQVMGATQEKGREAKHKASDASDRAMGMGHDAMEATREKARAAADRTMGMGHDAGEAAKDRAYRAKDAASGAAGRARDTASDAAGAAGDRARDGAQQTGSYVAQTAEAARQKAAGAALYAKDTVVAGKDKTGALLQQAGEKVMSTAVGAKDTVVSTAVGAKDTVVSTAVGAKDAMMNSLGMAGEDKDGTTTTDAGKDTSTRKPGRDYX

SEQ ID NO: 10850 - protein, 180 aa, Zea mays
  misc_feature (180)..(180): Xaa can be any naturally occurring amino acid
  unsure (1)..(180): unsure at all Xaa locations
GGRHRPLRAFSEVGWLLLPHRFVFRFWFVGEREEMAASDVEYRCFVGGLAWATDDHSLNNAFSTYGEVLESKIILDRETQRSRGFGFVTFSTEDAMRSAIEGMNGKELDGRNITVNEAQSRGGRGGGGGGYGGGRRDGGGYGGGGGGYGGGRGGYGGGGGYGGANRGGGYGNNDGNWRNX

SEQ ID NO: 10851 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALFX

SEQ ID NO: 10852 - protein, 245 aa, Zea mays
  misc_feature (245)..(245): Xaa can be any naturally occurring amino acid
  unsure (1)..(245): unsure at all Xaa locations
QHRKHNSVPTMAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALFX

SEQ ID NO: 10853 - protein, 235 aa, Zea mays; identical to SEQ ID NO: 10851
  misc_feature (235)..(235): Xaa can be any naturally occurring amino acid
  unsure (1)..(235): unsure at all Xaa locations

SEQ ID NO: 10854 - protein, 242 aa, Zea mays
  misc_feature (242)..(242): Xaa can be any naturally occurring amino acid
  unsure (1)..(242): unsure at all Xaa locations
KHNSVPTMAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALFX

SEQ ID NO: 10855 - protein, 245 aa, Zea mays; identical to SEQ ID NO: 10798
  misc_feature (245)..(245): Xaa can be any naturally occurring amino acid
  unsure (1)..(245): unsure at all Xaa locations

SEQ ID NO: 10856 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10857 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10858 - protein, 242 aa, Zea mays
  misc_feature (242)..(242): Xaa can be any naturally occurring amino acid
  unsure (1)..(242): unsure at all Xaa locations
KHNSVPTMAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALFX

SEQ ID NO: 10859 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPQCSQAPIASLLPPYLSPTVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPAAFYQQPIIGGALFX

SEQ ID NO: 10860 - protein, 245 aa, Zea mays
  misc_feature (245)..(245): Xaa can be any naturally occurring amino acid
  unsure (1)..(245): unsure at all Xaa locations
QHRKHNSVPTMAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPTAFYQQPIIGGALFX

SEQ ID NO: 10861 - protein, 235 aa, Zea mays; identical to SEQ ID NO: 10851
  misc_feature (235)..(235): Xaa can be any naturally occurring amino acid
  unsure (1)..(235): unsure at all Xaa locations

SEQ ID NO: 10862 - protein, 116 aa, Zea mays; identical to SEQ ID NO: 10748

SEQ ID NO: 10863 - protein, 293 aa, Zea mays
  misc_feature (293)..(293): Xaa can be any naturally occurring amino acid
  unsure (1)..(293): unsure at all Xaa locations
FATSQTGSSRVQAAAKMMAEAWTPVPFPPTAPCFWLHDTHSVFWRGGDAWTAAENKLFEKALAQIDRNAPDRWEKVAEVVRTKTVDDVRNHYHDLENDVGFIEAGLVPFPHYSGSVPSFGFTHHEDWDGGFRRGYCLKRARGSDPERKKGVPWTEEEHKLFLMGLKKYGRGDWRNISRKYVTTRTPTQVASHAQKYFIRLNSGGKDKRRSSIHDITTVNLPDEDRGNAPPSAVTTTTNPSVALPDMKPFIAPLQDALGVSHPYGNVKLEPKSSLVAGLGFNDSVLLMHCGQLX

SEQ ID NO: 10864 - protein, 185 aa, Zea mays; identical to SEQ ID NO: 10242
  misc_feature (185)..(185): Xaa can be any naturally occurring amino acid
  unsure (1)..(185): unsure at all Xaa locations

SEQ ID NO: 10865 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10866 - protein, 377 aa, Zea mays
NQDTHRSLVNMSSTFSSMLVSTLLSNPAIHAAARLAASYWPAAEGNTPIDPNQENLADGVQGRSIGSPPSMASIVAATVAAASAWWATQGLLPFFAPPMAFSFVPAPSAAFPTVDVPRPSEKDRDCPAENAQKECQEARKQGQFEGFRVAASSEYDGSGKGEVSVHTELKISPVQNADATSAAGADTTDAFMNKKKQDRSSCGSNTPSSSDVDVDNVPEKEGNGNEKAKQASCSNSSAGDTNHRRFRSSGSTSDSWKEVSEEGRLAFHALFSREKLPQSFSPPQAEGSKEVGKEEEDEVTTVAVDLNKSTTSIDHDLDTIGEPRASFPNELSPLKLKLRRTGFKPYKRCSVEAKENRVPASDEVGTKRIRLDSEAST

SEQ ID NO: 10867 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10868 - protein, 170 aa, Zea mays
  misc_feature (170)..(170): Xaa can be any naturally occurring amino acid
  unsure (1)..(170): unsure at all Xaa locations
LDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10869 - protein, 183 aa, Zea mays; identical to SEQ ID NO: 10429
  misc_feature (183)..(183): Xaa can be any naturally occurring amino acid
  unsure (1)..(183): unsure at all Xaa locations

SEQ ID NO: 10870 - protein, 177 aa, Zea mays
  misc_feature (177)..(177): Xaa can be any naturally occurring amino acid
  unsure (1)..(177): unsure at all Xaa locations
MGGCCCCSSRTSEADRAPIDIYRQQNLEEHEPLSSAFDGSSPPSSIVAVDTNLDTSTPDTYRAPPAPLPYDVVLAVPTTPGLEKLDNKSKTDDQQESINDQESLKVDESCKKNVTEDKAEEEDVCPICLEEYDEENPRSVTKCEHHFHLCCILEWMERKDTCPVCDQTILVDEMSEX

SEQ ID NO: 10871 - protein, 505 aa, Zea mays; identical to SEQ ID NO: 10697
  misc_feature (505)..(505): Xaa can be any naturally occurring amino acid
  unsure (1)..(505): unsure at all Xaa locations

SEQ ID NO: 10872 - protein, 257 aa, Zea mays
  misc_feature (257)..(257): Xaa can be any naturally occurring amino acid
  unsure (1)..(257): unsure at all Xaa locations
TPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEDPEKYQSHFSAYIKKGVEADEIEALYKKVHAAIRADPSIVKSTKQPPKEHKRYNPKKLTYEQRKASLIERLNQLNSSGGADDDDEDDEX

SEQ ID NO: 10873 - protein, 163 aa, Zea mays
  misc_feature (163)..(163): Xaa can be any naturally occurring amino acid
  unsure (1)..(163): unsure at all Xaa locations
FVGERIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRNX

SEQ ID NO: 10874 - protein, 167 aa, Zea mays
  misc_feature (167)..(167): Xaa can be any naturally occurring amino acid
  unsure (1)..(167): unsure at all Xaa locations
RTYLLYYTLGSKDTTAMAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLQQQLPFMFNPMAMTIPPMFLQQPFVGAAFX

SEQ ID NO: 10875 - protein, 158 aa, Zea mays; identical to SEQ ID NO: 9900
  misc_feature (158)..(158): Xaa can be any naturally occurring amino acid
  unsure (1)..(158): unsure at all Xaa locations

SEQ ID NO: 10876 - protein, 172 aa, Zea mays
  misc_feature (172)..(172): Xaa can be any naturally occurring amino acid
  unsure (1)..(172): unsure at all Xaa locations
ENFPHSPVAAAPVAMDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASAGSKEPKSPKKGAKSPKKAX

SEQ ID NO: 10877 - protein, 183 aa, Zea mays; identical to SEQ ID NO: 10678
  misc_feature (183)..(183): Xaa can be any naturally occurring amino acid
  unsure (1)..(183): unsure at all Xaa locations

SEQ ID NO: 10878 - protein, 203 aa, Zea mays
  misc_feature (203)..(203): Xaa can be any naturally occurring amino acid
  unsure (1)..(203): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGVATVAAATATPTGTGGTERWGPRGQVILFAAVMFTLVQRVYLRSSRVCCCPSVFLIARSLCVSCX

SEQ ID NO: 10879 - protein, 163 aa, Zea mays; identical to SEQ ID NO: 10873
  misc_feature (163)..(163): Xaa can be any naturally occurring amino acid
  unsure (1)..(163): unsure at all Xaa locations

SEQ ID NO: 10880 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 10881 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10882 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 10883 - protein, 263 aa, Zea mays
  misc_feature (263)..(263): Xaa can be any naturally occurring amino acid
  unsure (1)..(263): unsure at all Xaa locations
LPHFCCCWLVGLRLFGQLAFPGLGTLPFREAVKGSATTMVRGKTELKRIENATSRQVTFSKRRNGLLKKAFELSVLCDAEVGLVVFSPRGKLYEFASAASLQKTIDRYRTYTRENVNNKTVQQDIQQVKADAVSLASRLEALEKTKRMFLGENLEECSIEELHNLEVKLAKSLHVIRGKKTQLLEQQISKLKEKERTLLQDNKELRDKQRNLQSPPEAPPDLNRCVPPWPRSLPAPSNDMDVETELYIGLPGRERSSNRDSDX

SEQ ID NO: 10884 - protein, 118 aa, Zea mays
QLVAAAVLAAALLLLAAGAGTASAAVSCGEVTSSVAPCLGYAMGSAASPSAACCSGVRSLNSRASSTADRQATCNCLKSMTGRLGGGVSMANAANIPGKCGVSVGVPISPTVDCTKIN

SEQ ID NO: 10885 - protein, 227 aa, Zea mays
  misc_feature (227)..(227): Xaa can be any naturally occurring amino acid
  unsure (1)..(227): unsure at all Xaa locations
RDLDLGLSASVATATIFPQCSQAPIASLLSPYLSPAVSSVCENPIVQPYRIQQAIATGILPLSPLFLQQPSALLQELPLVHLVAQNIRAQQLQQLVLANLAAYSQQHQFLPFNQLAALNSAAYLQQQLPFSQLAAAYPQQFLPFNQLAALNSAAYLQQQQLLPFSQLADVSPAAFLTQQQLLPFYLHAMPNAGTLLQLQQLLPFNQLALTNPAVFYQQPIIGGALFX

SEQ ID NO: 10886 - protein, 179 aa, Zea mays
  misc_feature (179)..(179): Xaa can be any naturally occurring amino acid
  unsure (1)..(179): unsure at all Xaa locations
SISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10887 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10888 - protein, 304 aa, Zea mays
  misc_feature (304)..(304): Xaa can be any naturally occurring amino acid
  unsure (1)..(304): unsure at all Xaa locations
RMGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEDPEKYQSHFSAYIKKGVEADEIEALYKKVHAAIRADPSIVKSTKQPPKEHKRYNPKKLTYEQRKASLIERLNQLNSSGGADDDDEDDEX

SEQ ID NO: 10889 - protein, 219 aa, Zea mays
  misc_feature (219)..(219): Xaa can be any naturally occurring amino acid
  unsure (1)..(219): unsure at all Xaa locations
QTPNIVEELKLARDIYEHAVVLSVKLEDQDAFERDFCQLKPYYMDTCGIIPASPEEYPILGLNLLRLLVQNRIAEFHTELELLPVKALEHPCIKHAVELEQSFMEGAYNRVLSARQAVPHETYVYFIDLLAKTVRDEIAGCSEKGYDSLSVSDAKQMLMFSSDQDLHEYITEEHPEWEIKNGAVFFQKAKESQPCKEIPSLQLINQTLSYARELERIVX

SEQ ID NO: 10890 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 10891 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10892 - protein, 304 aa, Zea mays; identical to SEQ ID NO: 10888
  misc_feature (304)..(304): Xaa can be any naturally occurring amino acid
  unsure (1)..(304): unsure at all Xaa locations

SEQ ID NO: 10893 - protein, 331 aa, Zea mays
  misc_feature (331)..(331): Xaa can be any naturally occurring amino acid
  unsure (1)..(331): unsure at all Xaa locations
MPLPIDGRRERAVCVRGAGAGAMEINIVDKYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQFX

SEQ ID NO: 10894 - protein, 269 aa, Zea mays
  misc_feature (269)..(269): Xaa can be any naturally occurring amino acid
  unsure (1)..(269): unsure at all Xaa locations
IRLINQDKNKYNTPKYRFVVRFTNKDITAQIISASIAGDMVLASAYSHELPRYGLEVGLTNYAAAYCTGLLLARRVLKTRGLDKEYEGNVEATGEDFSVEPADERRPFRALLDVGLIRTTTGNRVFGALKGALDGGLDIPHSEKRFAGFKKDDKQLDADIHRKYIYGGHVADYMRNLAEEEPEKYQSHFSEYIKKGIEADDMEALYKKVHAAIRADPSVVKSTKQPPKEHKRYNPKKLTYEQRKASLIERLNQLNSSGGADDDDEDDEX

SEQ ID NO: 10895 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 10896 - protein, 243 aa, Zea mays
  misc_feature (243)..(243): Xaa can be any naturally occurring amino acid
  unsure (1)..(243): unsure at all Xaa locations
RKHNSVPTMAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALFX

SEQ ID NO: 10897 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10898 - protein, 275 aa, Zea mays
  misc_feature (275)..(275): Xaa can be any naturally occurring amino acid
  unsure (1)..(275): unsure at all Xaa locations
PRSAPVHHLASHSRKYLYSLINMSREENVYMAKLAEQAERYEEMVEYMEKVAKTTDVQELTVEERNLLSVAFKNVIAAPRASWRIISSIEQKEESRKNEEHVAQIKEYRGKIEAELSNICDGILKLLDTHLVPSSTATESKVFYLKMKGDYHRYLAEFKTGAERKESAESTMVAYKAAQDIALAELPPIHPIRLGLALNFSVFYYEIQNSPDKACNLAKEAFDEAISQLDMLGEDSYKDSNLIMQLLRDNLTLWTEDGIEEGLESSKGDAGEGQX

SEQ ID NO: 10899 - protein, 479 aa, Zea mays
  misc_feature (479)..(479): Xaa can be any naturally occurring amino acid
  unsure (1)..(479): unsure at all Xaa locations
SRTPTMAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDLX

SEQ ID NO: 10900 - protein, 178 aa, Zea mays
  misc_feature (178)..(178): Xaa can be any naturally occurring amino acid
  unsure (1)..(178): unsure at all Xaa locations
AFLPSPKTSSDPRSAAAAMDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKAX

SEQ ID NO: 10901 - protein, 349 aa, Zea mays
  misc_feature (349)..(349): Xaa can be any naturally occurring amino acid
  unsure (1)..(349): unsure at all Xaa locations
PPLLSPLPHLCVRALCLFRRQPRGAMAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKAX

SEQ ID NO: 10902 - protein, 808 aa, Zea mays
  misc_feature (808)..(808): Xaa can be any naturally occurring amino acid
  unsure (1)..(808): unsure at all Xaa locations
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLEIIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRSKDNPEAMEEDEVDDIAEIKAAHFEESMKYARRSVSDADIRKYQAFAQTLQQSRGFGSEFRFPDQPTAAAAAADPFASAAAAADDDDLYSX

SEQ ID NO: 10903 - protein, 235 aa, Zea mays
  misc_feature (235)..(235): Xaa can be any naturally occurring amino acid
  unsure (1)..(235): unsure at all Xaa locations
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLPQLVLANLAAYSQQQQFLPFNQLAALNSASYLQQQQLPFSQLPVAYPQQFLPFNQLAALNSPAYLQQQQLLPFSQLAGVSPATFLTQPQLLPFYQHAAPNAGTLLQLQQLLPFNQLALTNLAVFYQQPIIGGALFX

SEQ ID NO: 10904 - protein, 334 aa, Zea mays; identical to SEQ ID NO: 10230

SEQ ID NO: 10905 - protein, 363 aa, Zea mays
  misc_feature (363)..(363): Xaa can be any naturally occurring amino acid
  unsure (1)..(363): unsure at all Xaa locations
ASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 10906 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPKCSQAPIASLLPPYLSPAVSSVCENPILQPYRIQQAITAGILPLSPLFLQQSSALLHQLPLVHLLAQNIRAQQLQQLVLANLAAYSQQHQFLPFNQLAALNSASYLQQQQLPFSQLPAAYPQQFLPFNQLAALNSPAYLQQQQLLPFSQLAGVSPATFLIQPQLLPFYQHAAPNAGTLLQLQQLLPFNQLALTNPAAFYQQPIIGGALFX

SEQ ID NO: 10907 - protein, 235 aa, Zea mays; identical to SEQ ID NO: 10792
  misc_feature (235)..(235): Xaa can be any naturally occurring amino acid
  unsure (1)..(235): unsure at all Xaa locations

SEQ ID NO: 10908 - protein, 358 aa, Gossypium hirsutum
  misc_feature (358)..(358): Xaa can be any naturally occurring amino acid
  unsure (1)..(358): unsure at all Xaa locations
GIRNQREWQWKMAASSDPNPEGSDEQQKRSEIYTYEAPWHIYAMNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMSQPVEGGLDPILAYTAGAEIEQLQWSSSQPDWVAIAFSTKLQILRVX

SEQ ID NO: 10909 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 10910 - protein, 392 aa, Zea mays
  misc_feature (392)..(392): Xaa can be any naturally occurring amino acid
  unsure (1)..(392): unsure at all Xaa locations
MADQQQPQQQPQEMDVDRTGGLELPPGFRFHPSDFEIVNDYLTKKVHDRDYSCIAIADADLNKTEPWDLPKVAKMGEKEWYFFYQKDRKYPTGLRANRATEAGYWKATGKDKEVYDPLAAEGLLLVGMKKTLVFYKGRAPRGDKTNWVMHEYRLEGSGRLPASPASASGSATNIAAAMMKASASACKDEWVVCRVFNKTTGIKKTAAPAYQVAMAGAEMDQNQNNIPAIPIPMPLQLPLPVPMQMQFPILPDFAMDPVAPYYPNPNAGAGMMPPMALAGMGGAGGLQINGALFGNPVPAPLPMNFYHHQMGMGAAAGQVDMGAAAGQMDMGAAGAGAGGFDVAAPESRPSSMVSQKDEQANAAEISSMMSVTGPGSATTTIEMDGIWKYKYX

SEQ ID NO: 10911 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10912 - protein, 846 aa, Zea mays
  misc_feature (846)..(846): Xaa can be any naturally occurring amino acid
  unsure (1)..(846): unsure at all Xaa locations
QSLYLRINPSTSYPFVTPQASHRITTVELEQEQAVSACPRCSISIPHLMAPALSRTLGPSSVAALRPSPSCRGLLRAALAPQGRGASARCAVGVRWEAARRRRMAGVRCDAAVAEKPAGEEETAGEKYEYQAEVTRLMDLIVHSLYSHKEVFLRELVSNASDALDKLRFLSVTDPSVLADGGELEIRIKPDLEAGTITITDTGIGMTKDELKDCLGTIAQSGTSKFLKALKENKDLGADNGLIGQFGVGFYSAFLVAERVVVSTKSPKADKQYVWEAEADSSSYVIKEENDPEKMLSRGTEITLYLRDDDKYEFADPTRIQGLVKNYSQFVSFPIYTWQEKSRTVEVEEEEESKGEEATEESKSEEATEGEKQKKKKTITEKYWDWELANETKPIWMRNPKEVEKTEYNEFYKKTFNEFLDPLAYTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKTFDMIQEIAEKDGKEDYNKFWESFGKFMKLGCIEDTGNHKRLAPLLRFYSSKNETDLISLDQYVENMPENQKAIYYIATDSLQSAKTAPFLEKLVQKDIEVLYLIEPIDEVAIQNLQTYKEKKFVDISKEDLELGDEDEDKEKESKQEYTLLCDWIKQQLGDKVAKVQISKRLSSSPCVLVSGKFGWSANMERLMKAQTLGDTSSLEFMRGRRIFEINPDHPIIKDLNAACKNEPESTEAKRAAELLYEAALISSGYTPDSPAELGGKIYEMMTMALGGRWGRLETEEAEVIASIDDADSSEGATTTTEVVEPSEVRTESDPWKDX

SEQ ID NO: 10913 - protein, 301 aa, Zea mays
  misc_feature (301)..(301): Xaa can be any naturally occurring amino acid
  unsure (1)..(301): unsure at all Xaa locations
MGALDLHLDFASAQHGQAKLKEYAKSSLLSDGNYNTDKINGSNPDDYEKFEKGIMHYGCPHYRRRCRIRAPCCNEIFDCRHCHNETKNSIKIDKMKRHELPRHEVQQVVCSLCGTEQEVRQVCINCGVCMGKYFCGLCKLFDDDVSKQQYHCNGCGICRIGGRENFFHCSKCGCCYSIALKNSHACVEGAMHHDCPICFEYLFDSTNDVSVLPCGHTIHVKCLKEMEEHCQFACPLCSKSVCDMSKAWERLDMELATLSDSCDHKMVRILCNDCGAISDVQFHLIAHKCQNCKSYNTRQIX

SEQ ID NO: 10914 - protein, 745 aa, Zea mays
  misc_feature (745)..(745): Xaa can be any naturally occurring amino acid
  unsure (1)..(745): unsure at all Xaa locations
MAGQERRTIDLEEGWAFMQKGITKLKNILEGKPEPQFSSEDYMMLYTTIYNMCTQKPPQDYSQQLYDKYRESFEEYIASMVLPSLREKHDEFMLRELVQRWSNHKVMVRWLSRFFYYLDRYFISRRSLTPLKEVGLTCFRELIYQEIKGQVKDAVIALIDKEREGEQIDRALLKNVLDIFVEIGLGQMECYENDFEDFLLKDTTEYYSVKAQSWILEDSCPDYMIKAEECLKREKERVGHYLHISSEQKLLEKVQNELLAQYATPLLEKEHSGCSALLRDDKVEDLSRMYRLFSKISRGLEPISNMFKTHVTSEGTALVKQAEDSASNKKPEKKDMVGMQEQVFVWKIIELHDKYVAYVTECFQGHTLFHKALKEAFEVFCNKGVSGSSNAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAGHPELNPGIDLAVTVLTTGFWPSYKTFDINLPAEMVKCVEVFKEFYQTRTKHRKLTWIYSLGTCNINAKFDAKPIELIVTTYQAALLLLFNGSERLSYSEIATQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLERDKDNANTYKYLAX

SEQ ID NO: 10915 - protein, 458 aa, Zea mays; identical to SEQ ID NO: 10241
  misc_feature (458)..(458): Xaa can be any naturally occurring amino acid
  unsure (1)..(458): unsure at all Xaa locations

SEQ ID NO: 10916 - protein, 508 aa, Zea mays
  misc_feature (508)..(508): Xaa can be any naturally occurring amino acid
  unsure (1)..(508): unsure at all Xaa locations
PSLSFHFPISQIQFASSSSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10917 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 10918 - protein, 582 aa, Zea mays
  misc_feature (582)..(582): Xaa can be any naturally occurring amino acid
  unsure (1)..(582): unsure at all Xaa locations
MADEAKAKGNAAFSAGRFEEAARHFTDAIALAPDNHVLYSNRSAALASLHRYSDALADAQKTVELKPDWAKGYSRLGAAHLGLGDAASAVAAYEKGLELDPSNEGLKAGLQDAKKAAAAPPRRGSSGPDAIGQMFQGPELWSKIASDPSTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAVETYQAGLKHDPNNQELLDGVKRCVEQINKANRGEISQDELQERQNKAMQDPEIQNILTDPIMRQVLIDFQENPSAAQEHLKNPGVMQKIQKLVSAGIVQMRX

SEQ ID NO: 10919 - protein, 315 aa, Zea mays
  misc_feature (315)..(315): Xaa can be any naturally occurring amino acid
  unsure (1)..(315): unsure at all Xaa locations
LQETTAEPNRTSARGRREREAGSKTMEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRSX

SEQ ID NO: 10920 - protein, 390 aa, Zea mays
  misc_feature (390)..(390): Xaa can be any naturally occurring amino acid
  unsure (1)..(390): unsure at all Xaa locations
SFLPRHCAARVRRQPVTHSHSLDRSRPSAPSASPQGEEAMAAGGNGAGGDTRAAFARIYKTLKEELLTDPAFEFTEESRQWIDRMVDYNVLGGKCNRGLSVVDSYKLLKGADALGEEETFLACTLGWCIEWLQAFFLVLDDIMDDSHTRRGQPCWFRVPQVGLIAANDGIILRNHISRILRCHFKGKPYYADLLDLFNEVEFKTASGQLLDLITTHEGEKDLTKYNITVHGRIVQYKTAYYSFYLPVACALLLSGENLDNYGDVENILVEMGTYFQVQDDYLDCYGDPEFIGKIGTDIEDYKCSWLVVQALERADESQKRILFENYGKKDPACVAKVKNLYKELDLEAVFQEYENESYKKLIADIEAQPSIAVQKVLKSFLHKIYKRQKX

SEQ ID NO: 10921 - protein, 304 aa, Zea mays; identical to SEQ ID NO: 10888
  misc_feature (304)..(304): Xaa can be any naturally occurring amino acid
  unsure (1)..(304): unsure at all Xaa locations

SEQ ID NO: 10922 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 10923 - protein, 392 aa, Zea mays; identical to SEQ ID NO: 10910
  misc_feature (392)..(392): Xaa can be any naturally occurring amino acid
  unsure (1)..(392): unsure at all Xaa locations

SEQ ID NO: 10924 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10925 - protein, 220 aa, Zea mays
  misc_feature (220)..(220): Xaa can be any naturally occurring amino acid
  unsure (1)..(220): unsure at all Xaa locations
RKQGNHIAMAAKMFALFALLALCATATSATHIPGHLSPLLMPLATMNPWMQYCMKQQGVANLLAWPTLMLQQLLALPLQPCQMPMMMPGMMPPMTMMPMPNMMPSMMVPTMMSPITIASMMPPMMMPNMVSPMMMPSMMPSTMTPSMMPPIMMPSMIPPMMMPSMVSSMIMPNMMTVPQCYSDSISHIIQQQQLPFMFSPTAMAISPMFLQQPFVGAAFX

SEQ ID NO: 10926 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10927 - protein, 135 aa, Zea mays
  misc_feature (135)..(135): Xaa can be any naturally occurring amino acid
  unsure (1)..(135): unsure at all Xaa locations
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAASSKASVDDDDNX

SEQ ID NO: 10928 - protein, 462 aa, Zea mays
  misc_feature (462)..(462): Xaa can be any naturally occurring amino acid
  unsure (1)..(462): unsure at all Xaa locations
MQSLLVPTAASAPVAAPRARRNLPMRLSVRASATAAAAPRRETDPKKRVVITGMGLVSVFGNDVDAYYDRLLAGESGIGPIDRFDASKFPTRFAGQIRGFSSEGYIDGKNDRRLDDCLRYCIVSGKKALEAAGIAHGSKPMEKIDKTRAGVLVGTGMGGLTVFSDGVQNLIEKGYRKITPFFIPYAITNMGSALLGMDIGFMGPNYSISTACATSNYCFYAAANHIRRGEADIMIAGGTEAAIIPIGVGGFVACRALSQRNDDPKTASRPWDKDRDGFVMGEGAGVLVMESLEHAIKRDAPIIAEYLGGAVNCDAYHMTDPRSDGLGVSSCIKQSLEDAGVAPEEVNYINAHATSTLAGDLAEVNAIKQVFKDPSGIKINATKSMIGHCLGAAGGLEAIATVKAITTGWVHPSINQFNPEEAVEFDTVPNVKKQHEVNVGISNSFGFGGHNSVVVFAPFKPX

SEQ ID NO: 10929 - protein, 227 aa, Zea mays
  misc_feature (227)..(227): Xaa can be any naturally occurring amino acid
  unsure (1)..(227): unsure at all Xaa locations
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTTSSSSAAVVVGSFVKVSMDGAPYLRKVDLRMYRGYRELREALEAMFVSSSSANNLSEFAVTYEDKDGDLMLVGDVPFEMFASTCKKLRIMKRSEATGLGSSSARQQX

SEQ ID NO: 10930 - protein, 567 aa, Zea mays
  misc_feature (567)..(567): Xaa can be any naturally occurring amino acid
  unsure (1)..(567): unsure at all Xaa locations
MRPSDDRAQLSGFAQSDESTLDVEGHCCHQPSFPCSPSMQPIVSGCTHTENSAAYFLWPTSNLQHCAAEGRANYFANLSKGLLPKIGRRLPKGQQANSLLDLMTIRAFHSKVLRCFGLGTAVGFRIRKGVLTDIPAILCFVARKVHKKWLDPAHCLPAILAGPGGIWCDVDVVEFSYYGAPAQTPKVQIFTELVDKLCGSDECIGSGSQVASQDTFGTLGAIVKRRTGNKLVGFVTNRHVAVDLDYPNQKMYHPLPPNLGPGVYLGAVERATSFITDDVWYGIYAGTNPETFVRADGAFIPFAHDFDISTVTTTVRGVGDIGDVKVIDLQCPLNRLIGRRVCKIGRSSGHTTGTVMAYALEYNDEKGISFFTDLLVVGENRQTFDLEGDSGSLIILTGQDSEKPRPIGIIWGGTANRGRLKLRCDHGPQNWTSGVDLGRLLDRLELDLIITSESLKDAVQQQRRALAAAANSAAGESSTAAAPVLEEKVEEIFEPLGIKIEQLRRHDVSASEAEEAAGINVEERQFISNFVGRSPVRDDQGAPRQIANLNNPSEEELAMLLHLGDQX

SEQ ID NO: 10931 - protein, 593 aa, Zea mays
  misc_feature (593)..(593): Xaa can be any naturally occurring amino acid
  unsure (1)..(593): unsure at all Xaa locations
KLPGLGLVSIKEMEQRNVLALDEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNRLYEAVGENISGPSFHLNEYSSGTIQATGKPNNCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPKLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAEX

SEQ ID NO: 10932 - protein, 523 aa, Zea mays
  misc_feature (523)..(523): Xaa can be any naturally occurring amino acid
  unsure (1)..(523): unsure at all Xaa locations
NRFPLLRRCPADRGERSRSGATTMVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVSTATAEQSGDGVVAKKSVLEIEREVAARWMNAVNKKKTGVCX

SEQ ID NO: 10933 - protein, 449 aa, Zea mays; identical to SEQ ID NO: 10586
  misc_feature (449)..(449): Xaa can be any naturally occurring amino acid
  unsure (1)..(449): unsure at all Xaa locations

SEQ ID NO: 10934 - protein, 443 aa, Zea mays
  misc_feature (443)..(443): Xaa can be any naturally occurring amino acid
  unsure (1)..(443): unsure at all Xaa locations
MASRNHNAAAPQLHHHNRAGVPALGKAKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICKX

SEQ ID NO: 10935 - protein, 293 aa, Zea mays
  misc_feature (293)..(293): Xaa can be any naturally occurring amino acid
  unsure (1)..(293): unsure at all Xaa locations
MPVQCFVRRERATSTYLLYLGLSPSMNVEKDKLLLAARKVRRATRTYFVISLVSDDFSHSSSTYVGKLKPNFLGTKFTIFDSQPPPDAVVLPNNKTSKRQSKQVSPRLPLGNYNVATVTYELTVLRNRGPRRMQCTMHSIPAECIQEGGKAPTPTGAIQSLDEPVSTLPSAKGKEVAVEFSSTSLSADLSGPACVNGTPLVLKNKAPRWHEQLQCWCLNFRGRVTVASVKNFQLVASVDPSLNIPAAEQEKVILQFGKIGKDIFTMDYRYPLSAFQAFAICLTSFDTKPACEX

SEQ ID NO: 10936 - protein, 500 aa, Zea mays
  misc_feature (500)..(500): Xaa can be any naturally occurring amino acid
  unsure (1)..(500): unsure at all Xaa locations
HLPDPIREFSLLCGHGALCGEDLVWTGVQGQGSLAGGLRPLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10937 - protein, 246 aa, Zea mays
  misc_feature (246)..(246): Xaa can be any naturally occurring amino acid
  unsure (1)..(246): unsure at all Xaa locations
CLFLFLPPLSPSFLLLPAPLTQPPAMSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAARX

SEQ ID NO: 10938 - protein, 388 aa, Zea mays
  misc_feature (388)..(388): Xaa can be any naturally occurring amino acid
  unsure (1)..(388): unsure at all Xaa locations
ERGFAQASKEREREKEKKRKEGEGRDCSGEMPRHTAPAAPPSERGEMDEVVEADPDTEAEDQEERWATLLPELLSDVLLRVEASGAEQWPARKDIVSFACVCRWWRKAAVSVVRPPAESAKITFPSSLKQPGPRENPMQCFIMRNKNSTFYLYLGFTSSPVYKGKFLMAARRLRRGPHTEYIISLDAEDLSQGSNSYMGKLRSDFWGTNFKIYDSKPPYDGAKASSSRSSRRFGSRRISPQVSSGNYEVGQVSYKYNLLKSRGPRRMNCTLECPSAQETWENSLKTKFRRPLGPTTLRNKAPRWHEQLQCWCLNFHGRVTVASVKNFQLVTAAGPSDPTSNVDEETVLLQFGKVDDDIFTMDYRQPLSAFQAFAISLSSFGNKLACEX

SEQ ID NO: 10939 - protein, 371 aa, Zea mays
  misc_feature (371)..(371): Xaa can be any naturally occurring amino acid
  unsure (1)..(371): unsure at all Xaa locations
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEVPLSVCEWFKDYQPTAPGKQEVEHAYEFVKKKFEELYFQSSKPDRVDRVFKIYRTTALDQKLVKKTFKLIDESMRRSREGTX

SEQ ID NO: 10940 - protein, 184 aa, Zea mays
  misc_feature (184)..(184): Xaa can be any naturally occurring amino acid
  unsure (1)..(184): unsure at all Xaa locations
PSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10941 - protein, 560 aa, Zea mays
  misc_feature (560)..(560): Xaa can be any naturally occurring amino acid
  unsure (1)..(560): unsure at all Xaa locations
DFPIIYVNRGFESSTGYSAEEVLGRNCRFLQCRGPFAQRRHPLVDAAVVTRIRRCLDEGTEFHGDLLNFRKDCSPYMARLQLTPIYGDDEVITHYMGIQFFNDSNVDLGPSSGSVTKELARSTWIAPGNTDSPTPVGKGNLWEHSSLFLLSDEVICQKILSKLSPRDIASVNSVCKRLHHMTRNEDLWRMVCQNAWGTEATRALETVAGSRSLAWGRLARELTTLEAVAWRKLTVGGAVEPSRCNFSACAVGNRVVLFGGEGVNMQPMNDTFVLDLSASKPEWRHINVSAAPPGRWGHTLSCLNGSRLILFGGCGGQGLLNDVFILDLDAQHPTWREIPGLAPPVPRSWHSSCTVDGTKLVVSGGCADSGVLLSDTYLLDVTMERPVWREIPASWSPPSRLGHSLSVYDGRKILMFGGLAKSGPLRLRSSDVFTLDLSEDKPCWRCITGSRMPGAGNPAGVGPPPRLDHVVVSLPGGRVLIFGGSVAGLHSASKLYLLDPTEDKPTWRLLNVPGHPPRFAWGHSTCVVGGTKAIVLGGQTGEEWTLTEIHELSLASSLVX

SEQ ID NO: 10942 - protein, 192 aa, Zea mays
  misc_feature (192)..(192): Xaa can be any naturally occurring amino acid
  unsure (1)..(192): unsure at all Xaa locations
RSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 10943 - protein, 222 aa, Zea mays
  misc_feature (222)..(222): Xaa can be any naturally occurring amino acid
  unsure (1)..(222): unsure at all Xaa locations
EELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQX

SEQ ID NO: 10944 - protein, 351 aa, Zea mays
  misc_feature (351)..(351): Xaa can be any naturally occurring amino acid
  unsure (1)..(351): unsure at all Xaa locations
RPPPLLSPLPHLCVRALCLFRRQPRGAMAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKAX

SEQ ID NO: 10945 - protein, 158 aa, Zea mays
  misc_feature (158)..(158): Xaa can be any naturally occurring amino acid
  unsure (1)..(158): unsure at all Xaa locations
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASAGSKEPKSPKKGAKSPKKAX

SEQ ID NO: 10946 - protein, 333 aa, Zea mays
  misc_feature (333)..(333): Xaa can be any naturally occurring amino acid
  unsure (1)..(333): unsure at all Xaa locations
MSKARVYADVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWLKFMNADNQHLVSPEAIDFLDKLLRYDHQERLTALEAMTHPYFQQVRAAENSRTRAX

SEQ ID NO: 10947 - protein, 206 aa, Zea mays; identical to SEQ ID NO: 10568
  misc_feature (206)..(206): Xaa can be any naturally occurring amino acid
  unsure (1)..(206): unsure at all Xaa locations

SEQ ID NO: 10948 - protein, 249 aa, Zea mays; identical to SEQ ID NO: 9907

SEQ ID NO: 10949 - protein, 159 aa, Zea mays
MGFPVGYSESEMLLPRVLLQVLLLLGHFHRFLLWAFHAVGLGDLIDLGCNYPPPSASTAQEMMEHQGRDDVASPLQHQRTEFRPVAAALIEEALPVVRFDELGGAACGSGDCAVCLGGIGGGDEVRRLGNCRHAFHRACLDRWMAHDQRTCPLCRAPLI

SEQ ID NO: 10950 - protein, 269 aa, Zea mays
  misc_feature (269)..(269): Xaa can be any naturally occurring amino acid
  unsure (1)..(269): unsure at all Xaa locations
MSPSEPTREESVYMAKLAEQAERYEEMVEFMERVARYAGGAGGGEELSVEERNLLSVAYKNVIGARRASWRIISSIEQKEEGRGNEAHAASIRAYRSKIEAELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAAAAPKESAPEGQX

SEQ ID NO: 10951 - protein, 316 aa, Zea mays
  misc_feature (316)..(316): Xaa can be any naturally occurring amino acid
  unsure (1)..(316): unsure at all Xaa locations
PPTTTTPPLAAARSRPIRPDRPAMDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHAX

SEQ ID NO: 10952 - protein, 848 aa, Zea mays
SATEEASGAVSAVTVEKMLTVTASVQAAPAIGQMYFQRALDDAGDFFGKTLLMELVSSEVDAKTGLEKPRVTAFAHKTLREGHYEAEFKVPASFGPVGAVLLENEHHKEIFIREIKLVTGSDSSTAVTFGCNSWVHSKFDNPEKRIFFTLKSYLPSDTPKGLEDLRKKDLQALRGDGHGERKASERVYDYDVYNDLGDPDKNPAHQRPVLGGSKRYPYPRRCRTGRPRTRKDPEAEVRHGHNYVPRDEQFSEVKQLTFGATTLRSGLHALLPAIRPMLIKRELRFPHFPAIDDLYSDGIPLPAQTGLGAIRSIVPRVVKLVEDTTEHVLRFELPDMIERDRFSWFKDEEFARQTIAGLNPLCIQLLTEFPIRSKLDPEVYGPAESAITKEILEKHMSGGAAMTVEQALAAKRLFILDYHDVFLPYVHRVRELPDTTLYGSRTVFFLTDLGTLMPLAIELVRPKSPTQPQWKRVFTHGPDATDAWLWKLAKAHVVTHDTGYHQLVSHWLRTHCCVEPYIIAANRQLSRLHPVYRLLHPHFRYTMEINALAREALINADGIIEESFWPGRYAVELSSAAYGATWQFDTEALPNDLVKRGLAVRRDDGELELTIKDYPYAHDGLMVWNTIRQWAADYVNVYYKSDEAVAADPELKAFWDEVRNVGHGDKKDEPWWPVLDTRDSLAETLTTIMWVTSGHHSAVNFGQYHFGGYFPNRPTTIRKSMPVEEEAGRDEEMKKFLKQPETTLLDMLPTQMQAIRVMTTLDILSSHSPDEEYMGELAEPSWLEEPMVKAAFEKFGGRMKEIEGFIDECNNNPELRNRCGAGIVPYELLKPFSKPGVTGRGIPNSISI

SEQ ID NO: 10953 - protein, 635 aa, Zea mays
  misc_feature (635)..(635): Xaa can be any naturally occurring amino acid
  unsure (1)..(635): unsure at all Xaa locations
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEELDREMGLIRTQEETGRHVRMLTHEIRSTLDRHTILKTTLVELGRTLGLEECALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKALPDGRGSTPLKSRYQRSVX

SEQ ID NO: 10954 - protein, 273 aa, Zea mays
  misc_feature (273)..(273): Xaa can be any naturally occurring amino acid
  unsure (1)..(273): unsure at all Xaa locations
MWGFASNAWASGLGKRSPPNCTSSSAACSDDEASSCTSREEGLECPICWESFNIVENVPYVLWCGHTLCKNCVLGLQWAVIKVPTVPMQLPFFVCCPWCNLLSLRILYKGNLTFPRKNYFLLWMVEGMNGERARSRPATHSEQHTPWLSSSSRANGNAGCSNPTRRHLPLPPPVDTTSPTNANHANHGVPVPLLNAERVQASLRKSLSFLVHLTSKFPLVFIFLLIVLYAIPASAAVLLLYILITVLFALPSFLILYFAYPSLDWLVREIFAX

SEQ ID NO: 10955 - protein, 848 aa, Zea mays; identical to SEQ ID NO: 10952

SEQ ID NO: 10956 - protein, 574 aa, Zea mays
  misc_feature (574)..(574): Xaa can be any naturally occurring amino acid
  unsure (1)..(574): unsure at all Xaa locations
MAYFPDEVVGYILGYVTSHQDRNAVSLVCQAWYDIERHGRHSVLVRNCYAVCPERVHMRFPNMRALSLKGKPHFAEFNLVPAGWGATANPWVDACARACPGLEELRLKFMVVTDECLKLLSLSFTNFKSLVLVCCEGFSTTGLANIATNCRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTEEGLVALSSCRKLQHVLFSCVRMTNTALMTIARYCPRLTSFRLCIRKPRSADAVTGQPLDEGFGAIVRSCRGLRRLAMSGLLTDSVFLYIGMYAEKLEMLSVTFAGDTDDGMVYVLNGCRNLKKLVIKESPFGDAALLAGAHRYESMRSLWMSSCQITLGGCKALAATMPNINVEVIGGASFGAMDGGVSDARKVDMLYLYRTLAGPRCDTPGFVSILX

SEQ ID NO: 10957 - protein, 333 aa, Zea mays
  misc_feature (333)..(333): Xaa can be any naturally occurring amino acid
  unsure (1)..(333): unsure at all Xaa locations
MGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSPX

SEQ ID NO: 10958 - protein, 307 aa, Zea mays
  misc_feature (307)..(307): Xaa can be any naturally occurring amino acid
  unsure (1)..(307): unsure at all Xaa locations
MDPSQEKREIGWQKAARWAPPDPCPEAEPCPTKTTLLAVETTVAAASAAVNFNRHDASTTLQSAATCIPPPTTVRSVSMRDMGTEMTPIASQEPSRTGTPVRATSPNCSQPTTPRRTLGGPSAVGSFISHGGECSSSELSEQELQTKTRREIMLLGTQLGKTSIAAWASKKEEEKDASLSLKPVPMDQSTQNITAIRAAAWEEAEKAKYLARFKREEIKIQAWEDHQKAQIEAEMRKIEVEVERMRARAQDKLMTKLASARHSADEKRATAELKRNRAAARTAEQAEHIRRTGRVPPSFGCWNWCSX

SEQ ID NO: 10959 - protein, 338 aa, Zea mays; identical to SEQ ID NO: 10555

SEQ ID NO: 10960 - protein, 384 aa, Zea mays
  misc_feature (384)..(384): Xaa can be any naturally occurring amino acid
  unsure (1)..(384): unsure at all Xaa locations
MIGFPPWNCLPTGIAKIAAAAAVVVAALASSGIALPRPRAAPPPSGFGLLMSKAKVYTDVNVLRPKEYWDYEALTVQWGEQDDYEVVRKVGRGKYSEVFEGINVNNNEKCIIKILKPVKKKKIKREIKILQNLCGGPNIVKLLDIVRDQHSKTPSLIFEFVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNSYLNKYHIELDPQLEALVGRHSRKPWLKFMNGDNQHLVSPEAIDFLDKLLRYDHQDRLTAREAMAHPYFLQVRAVENSRTRAQX

SEQ ID NO: 10961 - protein, 160 aa, Zea mays
  misc_feature (160)..(160): Xaa can be any naturally occurring amino acid
  unsure (1)..(160): unsure at all Xaa locations
RIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRNX

SEQ ID NO: 10962 - protein, 360 aa, Zea mays; identical to SEQ ID NO: 10404

SEQ ID NO: 10963 - protein, 269 aa, Zea mays; identical to SEQ ID NO: 10272
  misc_feature (269)..(269): Xaa can be any naturally occurring amino acid
  unsure (1)..(269): unsure at all Xaa locations

SEQ ID NO: 10964 - protein, 217 aa, Zea mays; identical to SEQ ID NO: 9936
  misc_feature (217)..(217): Xaa can be any naturally occurring amino acid
  unsure (1)..(217): unsure at all Xaa locations

SEQ ID NO: 10965 - protein, 307 aa, Zea mays
  misc_feature (307)..(307): Xaa can be any naturally occurring amino acid
  unsure (1)..(307): unsure at all Xaa locations
RRFRSTGSSAPPTTVRPSVLPATPIRRPVPSHHTLPPLAAMSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQX

SEQ ID NO: 10966 - protein, 296 aa, Zea mays
  misc_feature (296)..(296): Xaa can be any naturally occurring amino acid
  unsure (1)..(296): unsure at all Xaa locations
MMRETYMDVLPPVDHIAARSNWFPAAARLWTAAENKQFERALAGLDLCRPDWEEVARAIPGRTVREVVSHFKHLEVDVQQIESGQVPLPAYGGGASSFTLQWDGYGPGPGDFRHGYRFAGGCGRRHHGRTPEQERKKGVPWTEEEHRLFLLGLKKYGKGDWRNISRNFVQTRTPTQVASHAQKYFIRLNSGGKDKRRSSIHDITTVNLTDDQPPSPSQSSLITSQSNAPATAPAAGICQVPLAADAKRHGAGTLPFSSPNRTSAAPAYRMEFHDQQGLQCGPLHDQLLASQSVLFX

SEQ ID NO: 10967 - protein, 182 aa, Zea mays; identical to SEQ ID NO: 5802

SEQ ID NO: 10968 - protein, 498 aa, Zea mays
  misc_feature (498)..(498): Xaa can be any naturally occurring amino acid
  unsure (1)..(498): unsure at all Xaa locations
QIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 10969 - protein, 353 aa, Zea mays
  misc_feature (353)..(353): Xaa can be any naturally occurring amino acid
  unsure (1)..(353): unsure at all Xaa locations
RLAPPPQQPLQPQSPTATMAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDLSTGLTTRRFVGHEKDVISVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQVSKNQILYCTSLSWSADGSTLYTGYTDGSIRVWKISGYGYAGX

SEQ ID NO: 10970 - protein, 320 aa, Zea mays
  misc_feature (320)..(320): Xaa can be any naturally occurring amino acid
  unsure (1)..(320): unsure at all Xaa locations
FFRQSRDSYRGGRKRWNNARGRAEMMRETYMDVLPPVDHIAARSNWFPAAARLWTAAENKQFERALAGLDLCRPDWEEVARAIPGRTVREVVSHFKHLEVDVQQIESGQVPLPAYGGGASSFTLQWDGYGPGPGDFRHGYRFAGGCGRRHHGRTPEQERKKGVPWTEEEHRLFLLGLKKYGKGDWRNISRNFVQTRTPTQVASHAQKYFIRLNSGGKDKRRSSIHDITTVNLTDDQPPSPSQSSLITSQSNAPATAPAAGICQVPLAADAKRHGAGTLPFSSPNRTSAAPAYRMEFHDQQGLQCGPLHDQLLASQSVLFX

SEQ ID NO: 10971 - protein, 195 aa, Zea mays
  misc_feature (195)..(195): Xaa can be any naturally occurring amino acid
  unsure (1)..(195): unsure at all Xaa locations
PVPIPPVSSARGTDTAPQQRSQPDQQTAGMALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDAX

SEQ ID NO: 10972 - protein, 179 aa, Zea mays
  misc_feature (179)..(179): Xaa can be any naturally occurring amino acid
  unsure (1)..(179): unsure at all Xaa locations
SSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10973 - protein, 168 aa, Zea mays; identical to SEQ ID NO: 10685

SEQ ID NO: 10974 - protein, 159 aa, Zea mays
  misc_feature (159)..(159): Xaa can be any naturally occurring amino acid
  unsure (1)..(159): unsure at all Xaa locations
DSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVAPKX

SEQ ID NO: 10975 - protein, 168 aa, Zea mays; identical to SEQ ID NO: 10685

SEQ ID NO: 10976 - protein, 165 aa, Zea mays
  misc_feature (165)..(165): Xaa can be any naturally occurring amino acid
  unsure (1)..(165): unsure at all Xaa locations
PSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDVSLLTSDGNTKDDLRLPTDETLVAQIKEGFESGKDLVVTVQSAMGEEQICALKDVGPKX

SEQ ID NO: 10977 - protein, 395 aa, Zea mays
  misc_feature (395)..(395): Xaa can be any naturally occurring amino acid
  unsure (1)..(395): unsure at all Xaa locations
NFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDDX

SEQ ID NO: 10978 - protein, 273 aa, Zea mays; identical to SEQ ID NO: 10954
  misc_feature (273)..(273): Xaa can be any naturally occurring amino acid
  unsure (1)..(273): unsure at all Xaa locations

SEQ ID NO: 10979 - protein, 182 aa, Zea mays
  misc_feature (182)..(182): Xaa can be any naturally occurring amino acid
  unsure (1)..(182): unsure at all Xaa locations
APLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 10980 - protein, 103 aa, Zea mays; identical to SEQ ID NO: 3555

SEQ ID NO: 10981 - protein, 423 aa, Zea mays
  misc_feature (423)..(423): Xaa can be any naturally occurring amino acid
  unsure (1)..(423): unsure at all Xaa locations
SPVLLLALLPPSPALCSDSPAPMAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENLESAPPPMKKDYKLANLLCWEEEADAMEEKAGVLDEX

SEQ ID NO: 10982 - protein, 435 aa, Zea mays
  misc_feature (435)..(435): Xaa can be any naturally occurring amino acid
  unsure (1)..(435): unsure at all Xaa locations
MYMPPPPPTGGAGEQPRLYQVWRGSNEFFLQGRFIFGPDVRSVFLTMILIIAPVVVFCLFVARHLINDFPDSWGISVMVVVVVFTIYDLTLLLCTSGRDPGIIPRNSHPPEPESIDGINDTGVQTPQQFRLPRTKEVIVNGISVRVKYCDTCMLYRPPRCSHCSFCNNCVERFDHHCPWVGQCIGLRNYRFFYMFVFSTTLLCLYVFAFCWVYVIKIRAAEQSSVWKALLKTPASVALIIYCFLCVWFVGGLSVFHLYLMSTNQTTYENFRYRYDRRDNPYNKGVLNNFLEIFCTAIPPSKNNFRARVTAGQGLQQTRSQSRGFMSPSMGKPIGDLEMDRKPVAPWDEPRTAADIRDLEAGLGVMFDEKEGRVAHASPDLSRDLPAEFVEGRSGMHSRQSSWVQRGDAIEASAVQMANARTTEASNNVAWSGTHX

SEQ ID NO: 10983 - protein, 224 aa, Zea mays; identical to SEQ ID NO: 10523
  misc_feature (224)..(224): Xaa can be any naturally occurring amino acid
  unsure (1)..(224): unsure at all Xaa locations

SEQ ID NO: 10984 - protein, 511 aa, Zea mays
  misc_feature (511)..(511): Xaa can be any naturally occurring amino acid
  unsure (1)..(511): unsure at all Xaa locations
PTTIWWFLFSGEKKAEAILLGFQHFVVMLGTTVIIPSALVPQMGGGNEEKARVVQTILFVAGINTLFQTLFGTRLPVVMGGSYVFVGPTISIVLAGRYSNEADPHEKFLRTMRGTQGALLVASTIQIILGFSGLWRNVVKLLSPLAAVPLVSLVGFGLYELGFPGVAKCVEVGLPELLLLVVFSQYLPQVLDFGKSVFSRFSVLFTVAIVWLYAYILTIGGAYKNSPPKTQVHCRVDRSGLISGAPWISVPYPFQWGAPTFDAGEAFAMMMTSFIALVESTGAFIGASRYASATMIPPSIISRGVGWQGIGLLLDSFFGTANGTSVSVENIGLLALTRIGSRRVVQISAGFMIFFSVLGKFGALFASIPLPVFAGMYCLFFAYVGGVGLSLLQFCNLNSFRTKFIMGFAFFMGLSVPQYFNEYTAVASYGPVHTGARWFNDMINVPFTSKPFVAGLVAYILDNTLQVKESAVRKDRGNHWWEKFRSFKKDARSQEFYSLPFNLNKFFPSVX

SEQ ID NO: 10985 - protein, 351 aa, Zea mays
  misc_feature (351)..(351): Xaa can be any naturally occurring amino acid
  unsure (1)..(351): unsure at all Xaa locations
MDQSFGNLGAGAGSSSGGSNSKAAAAAVSSSSFLQLPLSTASPAYYGAPLALLHHAAAAPSSSQQQQQHHHHQYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGSX

SEQ ID NO: 10986 - protein, 441 aa, Zea mays
RHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 10987 - protein, 559 aa, Zea mays
  misc_feature (559)..(559): Xaa can be any naturally occurring amino acid
  unsure (1)..(559): unsure at all Xaa locations
LVGSLAELCEATMGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNENX

SEQ ID NO: 10988 - protein, 612 aa, Zea mays
  misc_feature (612)..(612): Xaa can be any naturally occurring amino acid
  unsure (1)..(612): unsure at all Xaa locations
MATMESLIGLVNRIQRACTVLGDHGGGGGEGSLWEALPSVAVVGGQSSGKSSVLESIVGRDFLPRGSGIVTRRPLVLQLHKTDGGHEYAEFLHAPRKRFTDFAAVRKEIADETDRITGKTKAISNVPIHLSIYSPHVVNLTLIDLPGLTKVAVEGQAESIVQDIENMVRSYVDKPNCIILAISPANQDIATSDAIKLARDVDPSGDRTFGVLTKLDLMDKGTNAVDVLEGRQYRLQHPWVGIVNRSQADINKNVDMLSARRKEKEYFESSPEYGHLAHKMGAEYLAKLLSQHLEAVIRAKIPSIIALINKTIDEIEAQLDRLGRPIGGDAGAQLYTILDMCRAFDRVFKEHLDGGRPGGDRIYGVFDNQLPAALKKLPFDRHLSMQNVRKVISEADGYQPHLIAPEQGYRRLIDSSLSYFKGPAEASVDAVHLVLKELVRRSIAATEELKRFPTLQSDIAAAANESLERFREDGRKTVLRLVEMEASYLTVEFFRKLPTEPEKAADKNTPVSDRYQDNHLRRIGSNVSSYINMVCETLRNTIPKAVVHCQVKEAKRNLLNRFYAHVGSKEKKQLSAMLDEDPALMEKRDALVKRLELYKSARNEIDSVAWKX

SEQ ID NO: 10989 - protein, 116 aa, Zea mays
  misc_feature (116)..(116): Xaa can be any naturally occurring amino acid
  unsure (1)..(116): unsure at all Xaa locations
PPLEFDLFAPPDMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGX

SEQ ID NO: 10990 - protein, 136 aa, Zea mays
  misc_feature (136)..(136): Xaa can be any naturally occurring amino acid
  unsure (1)..(136): unsure at all Xaa locations
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAGSSKASTVDDDDNX

SEQ ID NO: 10991 - protein, 370 aa, Zea mays; identical to SEQ ID NO: 10557
  misc_feature (370)..(370): Xaa can be any naturally occurring amino acid
  unsure (1)..(370): unsure at all Xaa locations

SEQ ID NO: 10992 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10993 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLGSLNSASYLQQQQLPFSQLPAAYPQQFLPFNQLAALNSPAYLQQQQLLPFSQLAGVSPATFLTQPQLLPFYQHVAPNAGTLLQLQQLLPFNQLALTNPAVFYQQPIIGGALFX

SEQ ID NO: 10994 - protein, 304 aa, Zea mays; identical to SEQ ID NO: 10888
  misc_feature (304)..(304): Xaa can be any naturally occurring amino acid
  unsure (1)..(304): unsure at all Xaa locations

SEQ ID NO: 10995 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 10996 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 10997 - protein, 213 aa, Zea mays
  misc_feature (147)..(147): Xaa can be any naturally occurring amino acid
  unsure (1)..(213): unsure at all Xaa locations
TEWRPPDAPVSASRRRLDVGRGKQNNAGSATASASLPRRGHREWKPEGGKRDGFLHLGGGGRGGGRAAGGRRLLRLPRPLPDPVPGELLPLVLWRVHHPRLELWTSCTGLQVSHLSPPYKSTGACCIIRAGGWSTSSTYSRRDSALXLYIWWSTTQPNSEVARPTLLHPKTVQRTNGPPADPPTRVQGADADDGRTECNLCAEPCRHSSRKHA

SEQ ID NO: 10998 - protein, 118 aa, Zea mays; identical to SEQ ID NO: 10001

SEQ ID NO: 10999 - protein, 149 aa, Zea mays; identical to SEQ ID NO: 5266

SEQ ID NO: 11000 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11001 - protein, 639 aa, Zea mays
  misc_feature (639)..(639): Xaa can be any naturally occurring amino acid
  unsure (1)..(639): unsure at all Xaa locations
AARRAEQRSAAQAPSNSGLRNRCSPSLPPSSSACLSPRRAMSEEDEDQPPPKRPCASPPADQVLDNVLETVLQFLDAPRDRSAASLVCRSWHRAESATRDSVAVRNLLAASATRAARRFPNARSLLLKGRPRFADFNLLPHGWDASAFRPWAAAVAAGSFPALTSLYLKRIPVTDADLDLLSRPLPASFRDLTLHLCDGFTSRGLASIASHCRGLRVLDVVECDMAEEQEVVDWVAAFPPEPTNLESLSFECYEPPVAFATLEALVARSPRLSRLGVNLHVSLGQLRRLMAHAPRLSHLGTGSFRPAEGGEEEAEFGEVVSAFVSAGRARTLVSLSGFRDLAQEYLPIIDVVCSHLKSLDLSYAAVTPNQILMFIGQCYNLETLWVLDSVRDEGLDAVGIYCKKLQTLRVLPLDAHEDADELVSEVGLTAIARGCPALRSILYFCQTMTNAAVVDMSLHCPELKVFWLCIMGRHQPDHATEEPMDEGFGAIVKNCRKLTRLSTSGQLTDRAFEYIGRHGKSLRTLSVAFAGNSDVALQYILRGCSKLEKLEIRDCPFGDAGLLSGMHHFYNMRFVWMSGCNLTLRGCKEVARGLPRMVVELINGQPDENERKESVDILYMYRSLDGPREDVPPFVKILX

SEQ ID NO: 11002 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11003 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11004 - protein, 459 aa, Zea mays; identical to SEQ ID NO: 10226
  misc_feature (459)..(459): Xaa can be any naturally occurring amino acid
  unsure (1)..(459): unsure at all Xaa locations

SEQ ID NO: 11005 - protein, 335 aa, Zea mays
  misc_feature (335)..(335): Xaa can be any naturally occurring amino acid
  unsure (1)..(335): unsure at all Xaa locations
MSESELAVIKPEALKTYIWLQCFDGSIQQVEEEVAMFCPMICREIVKNGTGSSKNHAIALPERVNPASLSLILDYCRFHQVTGRSNKERKSFDEKFVRIETERLCELTSAADSLQLKPLVDLTSRALARIIEGKTPEEIRDIFHLPDDLTEEEKLEPLKNVNDDPRIRLLNRLYAKKRKELQERQKLKDVQVQKEEKDERSLDELLCFINGDGGSGGGESSTKSKKKNKRRKDHAKNPAKADSESVNVEGAACVVPCKVDSSNVSRLPCQSPDMQDDVEYPFEDADLDDGLDPAMKEELDREVEDFARRLNSVWSESHIGGNGSVQRFPGFNHRX

SEQ ID NO: 11006 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 11007 - protein, 459 aa, Zea mays; identical to SEQ ID NO: 10226
  misc_feature (459)..(459): Xaa can be any naturally occurring amino acid
  unsure (1)..(459): unsure at all Xaa locations

SEQ ID NO: 11008 - protein, 397 aa, Zea mays; identical to SEQ ID NO: 10617
  misc_feature (397)..(397): Xaa can be any naturally occurring amino acid
  unsure (1)..(397): unsure at all Xaa locations

SEQ ID NO: 11009 - protein, 397 aa, Zea mays; identical to SEQ ID NO: 10617
  misc_feature (397)..(397): Xaa can be any naturally occurring amino acid
  unsure (1)..(397): unsure at all Xaa locations

SEQ ID NO: 11010 - protein, 682 aa, Zea mays
  misc_feature (682)..(682): Xaa can be any naturally occurring amino acid
  unsure (1)..(682): unsure at all Xaa locations
LLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWTEKTTEKEISDDEDEEDKKDEEGKVEDVDEKEEKEKKKKKIKEVSHEWQLVNKQKPIWMRKPEDITKEEYAAFYKSLTNDWEEHLAVKHFSVEGQLEFKAVLFVPKRAPFDLFDTRKKPNNIKLYVRRVFIMDNCEELIPEWLSFVKGIVDSEDLPLNISRETLQQNKILKVIRKNLVKKCIELFFEIAENKEDYNKFYESFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADTDMPPLEDDAGESKMEEVDX

SEQ ID NO: 11011 - protein, 250 aa, Zea mays; identical to SEQ ID NO: 10477
  misc_feature (250)..(250): Xaa can be any naturally occurring amino acid
  unsure (1)..(250): unsure at all Xaa locations

SEQ ID NO: 11012 - protein, 281 aa, Zea mays; identical to SEQ ID NO: 10178
  misc_feature (281)..(281): Xaa can be any naturally occurring amino acid
  unsure (1)..(281): unsure at all Xaa locations

SEQ ID NO: 11013 - protein, 258 aa, Zea mays
  misc_feature (258)..(258): Xaa can be any naturally occurring amino acid
  unsure (1)..(258): unsure at all Xaa locations
MSREDNVYMAKLAEQAERYEEMVEYMEKVAKTVDVEELTVEERNLLSVAYKNVIGARRASWRIISSIEHKEESRKNEEHVIQIKEYRGKIEAELSNICDGILKLIDSHLVPSSTAAESKVFYLKMKGDYHRYLAEFKTGAERKEAAESTMIAYKAAQDIALAELASTHPIRLGLALNFSVFYYEILNSPDKACNLARQAFDEAISQLDTLGEDSYKDSTLIMQLLRDNLTLWTADSTTEDGIEEGNEASKGDAGEGQX

SEQ ID NO: 11014 - protein, 157 aa, Zea mays
TASLPSRQKKKIRLGCLSLANRNGCCCHCYSGRGAGGRRPEGGGTAGRRGGSGAGAGGEARAGGGRQLRGPRGDRQDPTQLQIQSDDRGLGDARAGAAGAGAGPRREHDHHGLLDARDDRVRAAEAREGVVGAAGHPGGDHVVGERAHPHQPVPGGG

SEQ ID NO: 11015 - protein, 299 aa, Zea mays
  misc_feature (299)..(299): Xaa can be any naturally occurring amino acid
  unsure (1)..(299): unsure at all Xaa locations
MVEEGATAAASRSGPAPFLSKTHQMVEEPGTDEVISWAEQGRSFVVWKPVELARDLLPLHFKHCNFSSFVRQLNTYGFRKVVPDRWEFANENFRRGEQGLLSGIRRRKSTTPQPSKYGGGSVVNTAFPPPLPFPPPASVTTSGGGGGAGAGNERSSSSASSPPRTDDLTSENEQLKKDNRTLSTELAQARRHCEELLGFLSRFLDVRQLDLGLLMQEDVRAGAGDDAAPRRAMVSQLERGGEEGKSVKLFGVLLKDAARKRARCEEAAASERPIKMIRIGEPWIGVPSSGPGRCGGGNX

SEQ ID NO: 11016 - protein, 328 aa, Zea mays; identical to SEQ ID NO: 10632
  misc_feature (328)..(328): Xaa can be any naturally occurring amino acid
  unsure (1)..(328): unsure at all Xaa locations

SEQ ID NO: 11017 - protein, 189 aa, Zea mays; identical to SEQ ID NO: 10636
  misc_feature (189)..(189): Xaa can be any naturally occurring amino acid
  unsure (1)..(189): unsure at all Xaa locations

SEQ ID NO: 11018 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11019 - protein, 240 aa, Zea mays
  misc_feature (240)..(240): Xaa can be any naturally occurring amino acid
  unsure (1)..(240): unsure at all Xaa locations
AMSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 11020 - protein, 195 aa, Zea mays; identical to SEQ ID NO: 5801

SEQ ID NO: 11021 - protein, 168 aa, Zea mays; identical to SEQ ID NO: 10685

SEQ ID NO: 11022 - protein, 168 aa, Zea mays; identical to SEQ ID NO: 10685

SEQ ID NO: 11023 - protein, 132 aa, Zea mays
  misc_feature (22)..(22): Xaa can be any naturally occurring amino acid
  misc_feature (25)..(25): Xaa can be any naturally occurring amino acid
  misc_feature (69)..(69): Xaa can be any naturally occurring amino acid
  unsure (1)..(132): unsure at all Xaa locations
FLRRSGTSSVASRRKGSTSRGXSSXTWRGPSRSSTTLTFPTSLSSPGWWSTSFPAPWWRWCGRGRTSCXLAAGSLGPPGLGRQPPVPFVGTTPWKSAGMSSMEATPWRTGRRRSLSGSLKVWHSGRATFIPG

SEQ ID NO: 11024 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11025 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11026 - protein, 149 aa, Zea mays; identical to SEQ ID NO: 5266

SEQ ID NO: 11027 - protein, 304 aa, Zea mays; identical to SEQ ID NO: 10888
  misc_feature (304)..(304): Xaa can be any naturally occurring amino acid
  unsure (1)..(304): unsure at all Xaa locations

SEQ ID NO: 11028 - protein, 626 aa, Zea mays
  misc_feature (626)..(626): Xaa can be any naturally occurring amino acid
  unsure (1)..(626): unsure at all Xaa locations
PSNSGLRNRCSPSLPPSSSACLSPRRAMSEEDEDQPPPKRPCASPPADQVLDNVLETVLQFLDAPRDRSAASLVCRSWHRAESATRDSVAVRNLLAASATRAARRFPNARSLLLKGRPRFADFNLLPHGWDASAFRPWAAAVAAGSFPALTSLYLKRIPVTDADLDLLSRPLPASFRDLTLHLCDGFTSRGLASIASHCRGLRVLDVVECDMAEEQEVVDWVAAFPPEPTNLESLSFECYEPPVAFATLEALVARSPRLSRLGVNLHVSLGQLRRLMAHAPRLSHLGTGSFRPAEGGEEEAEFGEVVSAFVSAGRARTLVSLSGFRDLAQEYLPIIDVVCSHLKSLDLSYAAVTPNQILMFIGQCYNLETLWVLDSVRDEGLDAVGIYCKKLQTLRVLPLDAHEDADELVSEVGLTAIARGCPALRSILYFCQTMTNAAVVDMSLHCPELKVFRLCIMGRHQPDHATEEPMDEGFGAIVKNCRKLTRLSTSGQLTDRAFEYIGRHGKSLRTLSVAFAGNSDVALQYILRGCSKLEKLEIRDCPFGDAGLLSGMHHFYNMRFVWMSGCNLTLRGCKEVARGLPRMVVELINGQPDENERKESVDILYMYRSLDGPREDVPPFVKILX

SEQ ID NO: 11029 - protein, 410 aa, Agrobacterium tumefaciens
  misc_feature (410)..(410): Xaa can be any naturally occurring amino acid
  unsure (1)..(410): unsure at all Xaa locations
SKDSANKTDGLKMTNASEMPRKLTILGSTGSIGTNTLDVVRQLGGRDGFEIMALTGAGNIALLAEQAREFGAQLAVTADDDKYEALKSALAGTGIKVAAGMAGLEEAASMDAGWVMAAIAGTPGLAPTLTAARRGADIALANKECLVSAGDVFLRTVKQGGGRLIPVDSEHSAIFQCLTGEYKQAVERIVLTASGGPFRTWSRDEMSNVTADIARAHPNWSMGLKVSIGSASMFNKGLEMIEAKYLFDLRPDQVDVIVHPQSIIHSMVGYTDGSYIAQLGSPDMRTAISYALTYPERGNLSVERLDFAKLARLDFEAPDEARFPALRLARMALERGGLQGAALNAAEETAFHAFVAGGIGFLDMAEIVETVMDRMHDGRTAETMDDVFSADEEARRHALELIATKEKAAX

SEQ ID NO: 11030 - protein, 532 aa, Agrobacterium tumefaciens
  misc_feature (532)..(532): Xaa can be any naturally occurring amino acid
  unsure (1)..(532): unsure at all Xaa locations
MPQTPLLDRVNFPSDLKEIDDRDLPELARELRDEMIDAVSKTGGHLGAGLGVVELTIAIHKVFNTPEDRLIFDVGHQCYPHKILTGRRDRIRTLRQEDGLSGFTRRAESEYDDFGAGHSSTSISAGLGMAVAAGLDGSDRKVIAVIGDGSMSAGMAFEALNNAGALDARLIVILNDNDMSIAPPTGAMSAYLARLASGRTYMGFRDFGKKLTAYLGKTIDRAITRAVTHARGYVTGGTLFEELGFYHIGPIDGHSFDHLLPVLRNVRDNQKGPVLIHVVTQKGKGYAPAEAAADKYHGVNKFDVITGAQAKAKPNAPSYTSVFAEALIQEATLDEKIIGVTAAMPNGTGLDKMAELFPSRTFDVGIAEQHAVTFAAGLAADGYKPFCALYSTFLQRGYDQLVHDVAIQSLPVRFPIDRAGFVGADGPTHAGSFDTTFLATLPGMVVMAAADEAELKHMVRTAAAYDEGPISFRYPRGEGVGVEMPARGEILQIGKGRIIKEGTKVALLSFGTRLAECLAAAEDLDAAGLSLX

SEQ ID NO: 11031 - protein, 260 aa, Oryza sativa
  misc_feature (260)..(260): Xaa can be any naturally occurring amino acid
  unsure (1)..(260): unsure at all Xaa locations
RLPRIAPPRPRRDRSRRRLPPPASSSAMAPSLLGGFTKSLAMTVLSEIGDKTFFAAAILAMRYPRKLVLAGCLTSLTVMTALSVSLGWVAPNLISRKWTHHVTTLLFFVFGILSLWEGFKEDGDSEELAEVEAELDANFKSNKAESKSKSKANDDKKKQQRPFVLQFFSPIFIKAFSITFFGEWGDKSQIATIGLAADENPFGVVLGGVLAQALCTTAAVMGGKSLASQISEKMVGLSSGVLFLLFGIMSYLSGPEGELX

SEQ ID NO: 11032 - protein, 237 aa, Oryza sativa
  misc_feature (237)..(237): Xaa can be any naturally occurring amino acid
  unsure (1)..(237): unsure at all Xaa locations
KKPRKTLGPHPPPPPSPPPVNGSMSRHPEVKWAQRIDKVYITVQLADAKDAKVNLEPEGVFSFSATAGTDGNLYESKLELNDKVNVEESKISVGVRSIFCIVEKAEAKWWKKLVRDDQKAPHFVKVDWDKWVDEDDDGADVNVDGMDFSNFGGMGGMGGMGGMGDMMGGMGGMGGMGGMAEMMGGMGGMGGMGGMGGMDEFEDESDDEEEVSKPQDAEKAAEAGKSQESDAKAETSX

SEQ ID NO: 11033 - protein, 261 aa, Oryza sativa
  misc_feature (261)..(261): Xaa can be any naturally occurring amino acid
  unsure (1)..(261): unsure at all Xaa locations
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGHX

SEQ ID NO: 11034 - protein, 237 aa, Oryza sativa
  misc_feature (237)..(237): Xaa can be any naturally occurring amino acid
  unsure (1)..(237): unsure at all Xaa locations
EKPRKTLGPHPPPPPSPPPVNGSMSRHPEVKWAQRIDKVYITVQLADAKDAKVNLEPEGVFSFSATAGTDGNLYESKLELNDKVNVEESKISVGVRSIFCIVEKAEAKWWKKLVRDDQKAPHFVKVDWDKWVDEDDDGADVNVDGMDFSNFGGMGGMGGMGGMGDMMGGMGGMGGMGGMAEMMGGMGGMGGMGGMGGMDEFEDESDDEEEVSKPQDAEKAAEAGKSQESDAKAETSX

SEQ ID NO: 11035 - protein, 352 aa, Oryza sativa
  misc_feature (352)..(352): Xaa can be any naturally occurring amino acid
  unsure (1)..(352): unsure at all Xaa locations
GVPGPALAEYYAQRTTQGGLLISEGTVVSPAGPGFPHVPGIYNQEQTDAWKKVVDAVHAKGGIFFCQLWHVGRASHQVYQPNGAAPISSTDKPISARWRILMPDGSYGKYPKPRRLAASEIPEIVEQYRQAAINAIEAGFDGIEIHGAHGYIIDQFLKDGINDRTDEYGGSLSNRCRFLLEVTRAVVSAIGADRVAVRISPAIDHLDAYDSDPIKLGMAVVERLNALQQQSGRLAYLHVTQPRYTAYGQTESGQHGSAEEESRLMRTLRGTYQGTFMCSGGYTRELGLEAVESGDADLVSYGRLFISNPDLVERFRLNAGLNKYVRKTFYTPDPVVGYTDYPFLGQPKSRMX

SEQ ID NO: 11036 - protein, 355 aa, Sorghum bicolor
  misc_feature (25)..(25): Xaa can be any naturally occurring amino acid
  misc_feature (71)..(71): Xaa can be any naturally occurring amino acid
  misc_feature (117)..(117): Xaa can be any naturally occurring amino acid
  misc_feature (140)..(141): Xaa can be any naturally occurring amino acid
  misc_feature (167)..(167): Xaa can be any naturally occurring amino acid
  misc_feature (237)..(237): Xaa can be any naturally occurring amino acid
  misc_feature (240)..(240): Xaa can be any naturally occurring amino acid
  misc_feature (254)..(254): Xaa can be any naturally occurring amino acid
  misc_feature (259)..(259): Xaa can be any naturally occurring amino acid
  misc_feature (262)..(262): Xaa can be any naturally occurring amino acid
  misc_feature (281)..(281): Xaa can be any naturally occurring amino acid
  misc_feature (308)..(309): Xaa can be any naturally occurring amino acid
  misc_feature (313)..(313): Xaa can be any naturally occurring amino acid
  misc_feature (322)..(322): Xaa can be any naturally occurring amino acid
  misc_feature (334)..(334): Xaa can be any naturally occurring amino acid
  misc_feature (337)..(338): Xaa can be any naturally occurring amino acid
  unsure (1)..(355): unsure at all Xaa locations
STHASANGEQQEGVANPWAADRYPXAATTTTAPLRTSRAAPAPADAAASSACVRWPRRRRLSPPRRRPRAXRRASRGCTTSLRGCGRTSGATTCTTASTTRARPRPWPTTDAPRSAXSRRRSPSPPSHPQMIRRRHQKPXXMLDVALVVAQGTWLRNTEHSARGSHXALFKLKEEMLLLQRRGCRIRLLCKLLMLWSNRFLMGSLIWYGPWRVASTCRTRESLLVSWHASLLLEGQXSSXHGAIGTSNHLRLRXNPMNXVSXRGFAMRTTSQTGAHLQTMXTSPNHCLWRISRQLIGQRMWPHFGPLXXNQHXHGRASPLYXQADGRRSEGRWXCRXXSKVTRRGSSNSPSSPVA

SEQ ID NO: 11037 - protein, 223 aa, Sorghum bicolor
  misc_feature (223)..(223): Xaa can be any naturally occurring amino acid
  unsure (1)..(223): unsure at all Xaa locations
AAMADEIDTRPASAGSRGRPAHATEDDDREEGEIADDTPAPALPVTHPLEHSWTFWFDNPQGKNKQAAWGSSIRPIHTFSTVEDFWGLYNNIHHPSKLVIGADFHCFKNKIEPKWEDPICANGGKWTISCGRGKSDTLWLHTLLAMIGEQFDYGDEICGAVVSVRGKQERIAIWTKNAANEAAQISIGKQWKEFLDYKDSIGFIVHDDAKKADKGPRNRYTVX

SEQ ID NO: 11038 - protein, 135 aa, Oryza sativa
  misc_feature (135)..(135): Xaa can be any naturally occurring amino acid
  unsure (1)..(135): unsure at all Xaa locations
AGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANAX

SEQ ID NO: 11039 - protein, 314 aa, Sorghum bicolor
STHASAQSSTSPLACRRGSHYYYRAPSHVPRRSRPRGRGGVVSLRPMASSTAAQPPAPAPPGLKEGIAGLYDESSGLWENIWGDHMHHGFYDSGEAASMADHRRAQIRMIEEALAFAAVPSPDDPEKAPKTIVDVGCGIGGSSRYLAKKYGAQCKGITLSPVQAERGNALATAQGLSDQVTLQVADALEQPFPDGQFDLVWSMESGEHMPDKRKFVSELARVAAPGGTIIIVTWCHRNLEPSETSLKPDELSLLKRICDAYYLPDWCSPSDYVNIAKSLSLEDIKAADWSENVAPFWPAVIKSALTWKGLTSLL

SEQ ID NO: 11040 - protein, 448 aa, Sorghum bicolor
  misc_feature (448)..(448): Xaa can be any naturally occurring amino acid
  unsure (1)..(448): unsure at all Xaa locations
RDRGAMAGSSSMDTEAAGQQLKHGSGYSIPATAHAVDTDSWQQVSLLMVIGFNCAYVLSFSNLMMVPLGWAWGVACLLLVGAAAWYANWLLAGLHFVDGQRFIRYRDLMGFVFGRNMYYITWFLQFTTLLLCNMGFILLGARALKAINSEFTHTPARLQWFVTATGFIYFAFAYFVPTISAMRNWLATSAALTLAYDVALLAILIRDGKSNKQKDYNVHGTQAEKVFNALGAVAAILVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRLCARGLVFGFNVFVTALFPFMGDFVNLVGSFALVPLTFTFPSMAILKIKGKSGGRCNRLWHWGIIVFSSVLCVATTAAAVRLIFNNARIYHFFADMX

SEQ ID NO: 11041 - protein, 314 aa, Sorghum bicolor
  misc_feature (314)..(314): Xaa can be any naturally occurring amino acid
  unsure (1)..(314): unsure at all Xaa locations
GVVSLRPMASSTAAQPPAPAPPGLKEGIAGLYDESSGLWENIWGDHMHHGFYDSGEAASMADHRRAQIRMIEEALAFAAVPSPDDPEKAPKTIVDVGCGIGGSSRYLAKKYGAQCKGITLSPVQAERGNALATAQGLSDQVTLQVADALEQPFPDGQFDLVWSMESGEHMPDKRKFVSELARVAAPGGTIIIVTWCHRNLEPSETSLKPDELSLLKRICDAYYLPDWCSPSDYVNIAKSLSLEDIKAADWSENVAPFWPAVIKSALTWKGLTSLLTSGWKTIRGAMVMPLMIQGYKKGLIKFTIITCRKPGAAX

SEQ ID NO: 11042 - protein, 396 aa, Oryza sativa
  misc_feature (396)..(396): Xaa can be any naturally occurring amino acid
  unsure (1)..(396): unsure at all Xaa locations
QFPRRVTNTQHLNRALFSRPEQPESEARRSEGKSARQSKQTRRTARGAVAEESGAEMDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAKX

SEQ ID NO: 11043 - protein, 102 aa, Sorghum bicolor
MAEAHSGRRVGMVGDVRDAPEGHENDLEAIELARFAVDEHNSKTNAMLEFERLVKVRHQVVAGTMHHFTVQVKEAGGGKKLYEAKVWEKVWENFKQLQSFQP

SEQ ID NO: 11044 - protein, 380 aa, Sorghum bicolor
  misc_feature (380)..(380): Xaa can be any naturally occurring amino acid
  unsure (1)..(380): unsure at all Xaa locations
MVQQQAAKEVIPLLTPYKMGQFQLSHRVVLAPLTRCRSYGNVPQPHAAVYYSQRATKGGLLVAEATGVSPTAQGYPETPGIWTQEQVQAWKPIVDAVHRKGALFFCQIWHVGRVSTTELQPDGQAPISSTDKQISPDAESGMVYSKPRRLQTEEIPGIVDDFRRAARNAIEAGFDGVEIHGAHGYLLEQFMKESSNDRTDEYGGSLENRCRFAVEVVDAIVREVGAHRVGIRLSPFVDFVDCVDSDPVALGHYMIQQLNKHEGFLYCHMVEPRMAIVDGRRQIPHRLLPFRKASHGTFIAAGGYDREEGNKVVAEGYADLVAYGRLFLANPDLPKRFELNAPLNKYDRSTFYTQDPVVGYTDYPFLEDNCDNDESSNQAX

SEQ ID NO: 11045 - protein, 586 aa, Gossypium hirsutum
  misc_feature (586)..(586): Xaa can be any naturally occurring amino acid
  unsure (1)..(586): unsure at all Xaa locations
MSNWLGFSLTPDLRIDESFGREDHGGFPSVMPLRSDGSLCVVDPFRRSSIAADEDWRYENGIGSATANEQGPKLEDFLGCYSNSPSQETKAYCGTHENQNTVPSPTRINVNVAPNYSSSGDAEAAENFTNPSSFIQTYRNYNENPQTLMAGGHSLQQCDPNPNHNQRSGVHHVPFESATSVSGFKSWLRQTPFPGGKASGNETNNNFNFQALSLTMSPTSRNGFPAIAPLEVVDNRKRPVGKNLTRESVPRKSIDTFGQRTSQYRGVTRHRWTGRYEAHLWDNSCRKEGQTRKGRQVYLGGYDKEEKAAKAYDLAALKYWGPTTHINFPLSTYEKELEEMKNMTRQEFVAHLRRKSSGFSRGASVYRGVTRHHQHGRWQARIGRVAGNKDLYLGTFSTQEEAAEAYDIAAIKFRGTSAVTNFDISRYDVKRICSSSTLIGGELAKRSPKDTASIAPEDYNSCASSASPQPLLAIPSGEASDELADMVWTANSDEQQQHQSTNTNNDASLANSSSRNSSNPQSPKGSIGLASDKFGIGGDYSHHGYFSLKGSKYEDGNSETDNSNENRLGNLGLVHKIPMFALWNEX

SEQ ID NO: 11046 - protein, 288 aa, Zea mays
  misc_feature (288)..(288): Xaa can be any naturally occurring amino acid
  unsure (1)..(288): unsure at all Xaa locations
MVGLSEGEKHFIRGGIAQDLRTDGRRRLQFRSLSVQTGVIPQANGSARVRLGATDIIASVKAELGKPSILHPDKGKVAIFVDCSPTAEPLFEGRGSEELSAELSVSLQRCLLGGKSGAGAAIDLSSLIVVDGKVCWDLYIDGLVVSSDGNLLDALAVAIKVALSDTGIPKVNVSVSAASDEEPEVDVSDEEFLQFDTSGVPVIITLTKVGRHYIVDATSEEESQMSSAVSVSVNRHGQICGLTKRGGAGLDPSVIFDMISVAKHVSQQFISLLDSEIAAAEAEEEAQX

SEQ ID NO: 11047 - protein, 398 aa, Zea mays
  misc_feature (398)..(398): Xaa can be any naturally occurring amino acid
  unsure (1)..(398): unsure at all Xaa locations
KYKKNRSESEAAVSRLRLRRFGLQTPGMAAGAGGGELEALEGVRSIVLKPSESLDESRFTRIAGADFNDPAIGLQGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSKX

SEQ ID NO: 11048 - protein, 206 aa, Zea mays
  misc_feature (206)..(206): Xaa can be any naturally occurring amino acid
  unsure (1)..(206): unsure at all Xaa locations
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGGMGDMAGMGGLGGMGGMGDLGGMGGMGMDDFEDESDDEEELSKPQAADKAVEAEETESAETKTEAAQSSX

SEQ ID NO: 11049 - protein, 546 aa, Zea mays
  misc_feature (546)..(546): Xaa can be any naturally occurring amino acid
  unsure (1)..(546): unsure at all Xaa locations
MPIKFALENMSTQASNRSYRYPDRTQLPYHNGNPMHVGGNGNYCVQQNHDDVNYISSDDGSQSSSSRVQDFQAQFCTLDSSSANCVYPAHSSTSSQSISGSPLSQQESHSDHAYGSSPSASCITQVPTWTLKDLENVMLGPDSDIGSPDSSFLLDTALHGNNWRELLGIQTGDLRQVIVACGKAVDENAVYMDALMSELREMVSVSGEPMQRLGAYMLEGLIARLSFTGHALYKSLKCKEPVATSSELLSYMHLLYEICPFFKFGYMSANGAIAEAVKGEDIIHIIDFQIAQGSQWMTMIQALASRPGRRPYLRITGIDDSNSAHARGGGLDMVGQRLHRMAQSCGLPFEFNAVPAASHEVVFEDLCLRSGEAIVVNFAYQLHHTPDESVGIENHRDRILRMVKSLSPKVVTLVEQEANTNTAPFFLRYMETLDYYTAMFEAIDVACPRDDKKRISTEQHCVARDIVNLIACEGAERIERHEPFGKWRARLVMAGFRPYPLSPVVNRTIKTLLDSYHSHYRLEERDGILYLGWKNRKLVVSSAWCX

SEQ ID NO: 11050 - protein, 249 aa, Zea mays
  misc_feature (249)..(249): Xaa can be any naturally occurring amino acid
  unsure (1)..(249): unsure at all Xaa locations
STTIHQKAKHQPLMPSQSTHTSSSLSSSTTPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHSX

SEQ ID NO: 11051 - protein, 184 aa, Zea mays
  misc_feature (184)..(184): Xaa can be any naturally occurring amino acid
  unsure (1)..(184): unsure at all Xaa locations
MINLFKIKGQRKEEAASAAGKAPVKKQSAGELRLHKDISELNLPKTTSISFPNGKDDLMNFETTIRPDEGYYMGGTFVFTFQVSPSYPHDPPKVKCKTKVYHPNIDLEGNVCLNILREDWKPVLNINTVIYGLNLLFTQPNDEDPLNHEAAVVLRDNPKMFEANVRRAMAGGYVGQHYFQRCAX

SEQ ID NO: 11052 - protein, 372 aa, Zea mays
  misc_feature (372)..(372): Xaa can be any naturally occurring amino acid
  unsure (1)..(372): unsure at all Xaa locations
MGSGGANTAPLITPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGLYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDVX

SEQ ID NO: 11053 - protein, 345 aa, Zea mays
  misc_feature (22)..(22): Xaa can be any naturally occurring amino acid
  misc_feature (99)..(99): Xaa can be any naturally occurring amino acid
  misc_feature (104)..(104): Xaa can be any naturally occurring amino acid
  misc_feature (129)..(129): Xaa can be any naturally occurring amino acid
  misc_feature (138)..(138): Xaa can be any naturally occurring amino acid
  misc_feature (148)..(148): Xaa can be any naturally occurring amino acid
  misc_feature (153)..(153): Xaa can be any naturally occurring amino acid
  unsure (1)..(345): unsure at all Xaa locations
CFACVFHTCRAALLLDVAGRSXRRTATTSMGMTRTATTMATTTCSSSAASSSSSPSYLTSTTWRGSPSSPRPCRSRTPSSASASASQEPLLTGRSKEAXQVFGXGRLCRRFGASRRPSATLPSRTPTLXSSWKYRTPXSHRRPRTRRXRGRRXSRSLSRHSSTSAAAAWATPPSAATRRATSLPASACTVRTGSSTSPTRASSSTCWAGTRCTASRYSSSRSGSLAERFPDSGFVNGGSYTVRFACLRACRVNPLRVCLRTLYVASTTAVAVALPYFNEVLALLGALSFWPLAIYFPVEMYFIQRNVRRWSARWVVLQTFSVVCLLVSAFALVGSIEGLISKKLG

SEQ ID NO: 11054 - protein, 153 aa, Zea mays
  misc_feature (153)..(153): Xaa can be any naturally occurring amino acid
  unsure (1)..(153): unsure at all Xaa locations
SDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRNX

SEQ ID NO: 11055 - protein, 163 aa, Zea mays
  misc_feature (163)..(163): Xaa can be any naturally occurring amino acid
  unsure (1)..(163): unsure at all Xaa locations
VGGRIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRNX

SEQ ID NO: 11056 - protein, 157 aa, Zea mays
  misc_feature (14)..(14): Xaa can be any naturally occurring amino acid
  misc_feature (25)..(25): Xaa can be any naturally occurring amino acid
  misc_feature (104)..(104): Xaa can be any naturally occurring amino acid
  misc_feature (126)..(126): Xaa can be any naturally occurring amino acid
  misc_feature (134)..(134): Xaa can be any naturally occurring amino acid
  misc_feature (142)..(142): Xaa can be any naturally occurring amino acid
  unsure (1)..(157): unsure at all Xaa locations
GRRRRRWGAGRCSXSGSRTRSTARXHSPSAARGYSRRRTRSPCSATPRSRSSSSPPRASSTSTLPIHVWTKFLNGMSATPMQKRFSFPQNMKLRAIGAMNIENXRRRSRQYRNVKSTSWERILKLXISKSFSNXSSSWRVHXNISEQGRASLWSSQF

SEQ ID NO: 11057 - protein, 201 aa, Oryza sativa
  misc_feature (201)..(201): Xaa can be any naturally occurring amino acid
  unsure (1)..(201): unsure at all Xaa locations
MASHQDQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDHX

SEQ ID NO: 11058 - protein, 236 aa, Oryza sativa
  misc_feature (236)..(236): Xaa can be any naturally occurring amino acid
  unsure (1)..(236): unsure at all Xaa locations
KPRKTLGPHPPPPPSPPPVNGSMSRHPEVKWAQRIDKVYITVQLADAKDAKVNLEPEGVFSFSATAGTDGNLYESKLELNDKVNVEESKISVGVRSIFCIVEKAEAKWWKKLVRDDQKAPHFVKVDWDKWVDEDDDGADVNVDGMDFSNFGGMGGMGGMGGMGDMMGGMGGMGGMGGMAEMMGGMGGMGGMGGMGGMDEFEDESDDEEEVSKPQDAEKAAEAGKSQESDAKAETSX

SEQ ID NO: 11059 - protein, 340 aa, Zea mays
VQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPEEIRRGGFDVLAVHHPEGEVINSVIIARKPVAVDAHATGGVGHAHVHAHGAVLSRPCLCCEMEARAHQKMEEVAVEQLPS

SEQ ID NO: 11060 - protein, 173 aa, Zea mays
  misc_feature (173)..(173): Xaa can be any naturally occurring amino acid
  unsure (1)..(173): unsure at all Xaa locations
PRMAPQGRRATRRYGGVPEMGGASASASSGAGADERPKGEDGKQGQVAAGAQPPAGGKKRGRTAGDKEQNRLKRLLRNHVSAQQARERKKAYLTELEAKAKGLELRNAELEQRVSTLQNENNTLRQVIDVSGKEFKFTWASGRGELCDIYEERQSGEDGNGLLLECGSTWRKX

SEQ ID NO: 11061 - protein, 425 aa, Zea mays
  misc_feature (425)..(425): Xaa can be any naturally occurring amino acid
  unsure (1)..(425): unsure at all Xaa locations
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQFCPSMLAAAAIYTAQCTINGFKSWNKCCELHTRYSEEHLMVCSRMMVELHQRAAHGKLTGVHRKYNTSRYSYAAKSEPATFLLDAX

SEQ ID NO: 11062 - protein, 250 aa, Zea mays
  misc_feature (250)..(250): Xaa can be any naturally occurring amino acid
  unsure (1)..(250): unsure at all Xaa locations
SHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKAX

SEQ ID NO: 11063 - protein, 574 aa, Zea mays
  misc_feature (574)..(574): Xaa can be any naturally occurring amino acid
  unsure (1)..(574): unsure at all Xaa locations
MAYFPDEVVGYILGYVTSHQDRNAVSLVCRAWYDIERHGRHSVLVRNCYAVCPERVHMRFPNMRALSLKGKPHFAEFNLVPAGWGATANPWVDACARACPGLEELRLKFMVVTDECLKLLSLSFTNFKSLVLVCCEGFSTTGLANIATNCRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTEEGLVALSSCRKLQRVLFSCVRMTNTALMTIARYCPRLTSFRLCIRKPRSADAVTGQPLDEGFGAIVRSCRGLRRLAMSGLLTDSVFLYIGMYAEKLEMLSVTFAGDTDDGMVYVLNGCRNLKKLVIKESPFGDAALLAGAHRYESMRSLWMSSCQITLGGCKALAATMPNINVEVIGGASFGAMDGGVSGARKVDMLYLYRTLAGPRCDTPGFVSILX

SEQ ID NO: 11064 - protein, 243 aa, Zea mays
RSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKS

SEQ ID NO: 11065 - protein, 380 aa, Zea mays
  misc_feature (380)..(380): Xaa can be any naturally occurring amino acid
  unsure (1)..(380): unsure at all Xaa locations
MGAELGEAGVPARDMVDALEGVRSILLKPSERLDDKRFTRIAGADFDDAGLGLAGLLGSLASTGFQASNLGDAIDVVNQMLDWRLSHEKPSDDCAEAELDPAYRESVKCKIFLGFTSNLVSSGVREIIRFLVQHRMVDVIVTTAGGIEEDLIKCLAPTYRGDFTLPGALLRSRGLNRIGNLLVPNDNYCKFEHWIMPILDKMLLEQSTQNVWTPSKVIARLGKEINDESSYLYWAYKNNIPVFCPALTDGSIGDMLFCHSVHSPGLVVDIVQDVRLMNAETIHASPRKTGIILLGGGLPKHHICNANMLRDGADYAVYVNTAQEFDGSDSGARPDEAVSWGKIKSSARTVKVHCDATIAFPLLVAATFARKVHGTKSTNX

SEQ ID NO: 11066 - protein, 644 aa, Zea mays
  misc_feature (644)..(644): Xaa can be any naturally occurring amino acid
  unsure (1)..(644): unsure at all Xaa locations
AAVGFAEPEPPEMTVDELKLQARASGGHGAKDQFPVGMRVLAVDDDPTCLKILENLLLRCQYHVTTTGQAATALKLLREKKDQFDLVISDVHMPDMDGFKLLELVGLEMDLPVIMLSANGETQTVMKGITHGACDYLLKPVRIEQLRTIWQHVVRRRSCDAKNSGNDNDDSGKKLQVVSAEGDNGGVNRNKRISRKGRDDNGDDGDDSDDNSNENGDSSSQKKPRVVWSVELHRKFVAAVNQLGIDKAVPKKILDLMNVENITRENVASHLQKYRLYLKRLSADASRQANLTAAFGGRNPAYVNMGLDAFRQYNAYGRYRPVPTTNHSQPNNLLARMNSPAFGMHGLLPSQPLQIGHNQNNLSTSLGNVGGMNNGNLIRGAHMPLQDTSKCFPTGPSGNSFANISNSTQLVTTNNLPLQSLEPSNQQHLGRLHSSADPFNSFVGEPPQFADLGRCNTTWPTAVSSSNVQEIGQKDRIVNRPKLEPLSSFTEASSQIPLLGSEMQSHQVASLASNGLPMPFTQEAVPFAYGSSTNSREMLNNNLALSNSGVNSTLPNLRIDGSVVPGQTLGGSNSGGCVVPPLQDGRIDHQAVSSHLNYNNELMGTGRLQRGLSGGLDDIVVDMFRPDRADDGVSFIDGDWELVX

SEQ ID NO: 11067 - protein, 370 aa, Zea mays
  misc_feature (370)..(370): Xaa can be any naturally occurring amino acid
  unsure (1)..(370): unsure at all Xaa locations
MEGGRDVFLGAAARAPPPPPSCPFHGSATATRSGGAQMLSFSSNGVAGLGLCSGASKMQGVLSRVRRPFTPTQWMELEHQALIYKHFAVNAPVPSSLLLPIKRSLNPWSSLGSSSLGWAPFRSGSADAEPGRCRRTDGKKWRCSRDAVGDQKYCERHIKRGCHRSRKHVEGRKATPTTADPTMAVSGGSLLHSHAVAWQQQGKSSAANVTDPFSLGSNRNLLDKQNLGDQFSVSTSMDSFDFSSSHSSPNQAKVAFSPVAMQHEHDQLYLVHGAGSSAENVNKSQDGQLLVSRETIDDGPLGEVFKGKSCQSASADILTDHWTSTRDLRPPTGVLQMSSSNTVPAENHTSNSSYLMARMANSQTVPTLHX

SEQ ID NO: 11068 - protein, 483 aa, Zea mays; identical to SEQ ID NO: 10000

SEQ ID NO: 11069 - protein, 562 aa, Zea mays
  misc_feature (1)..(1): Xaa can be any naturally occurring amino acid
  misc_feature (6)..(6): Xaa can be any naturally occurring amino acid
  misc_feature (115)..(115): Xaa can be any naturally occurring amino acid
  misc_feature (122)..(122): Xaa can be any naturally occurring amino acid
  misc_feature (124)..(124): Xaa can be any naturally occurring amino acid
  misc_feature (166)..(166): Xaa can be any naturally occurring amino acid
  misc_feature (170)..(170): Xaa can be any naturally occurring amino acid
  misc_feature (220)..(220): Xaa can be any naturally occurring amino acid
  misc_feature (260)..(260): Xaa can be any naturally occurring amino acid
  misc_feature (286)..(286): Xaa can be any naturally occurring amino acid
  misc_feature (319)..(319): Xaa can be any naturally occurring amino acid
  misc_feature (325)..(325): Xaa can be any naturally occurring amino acid
  misc_feature (335)..(335): Xaa can be any naturally occurring amino acid
  misc_feature (337)..(337): Xaa can be any naturally occurring amino acid
  misc_feature (353)..(353): Xaa can be any naturally occurring amino acid
  misc_feature (360)..(360): Xaa can be any naturally occurring amino acid
  misc_feature (383)..(383): Xaa can be any naturally occurring amino acid
  misc_feature (388)..(388): Xaa can be any naturally occurring amino acid
  misc_feature (415)..(415): Xaa can be any naturally occurring amino acid
  misc_feature (425)..(425): Xaa can be any naturally occurring amino acid
  misc_feature (432)..(433): Xaa can be any naturally occurring amino acid
  misc_feature (477)..(477): Xaa can be any naturally occurring amino acid
  misc_feature (492)..(492): Xaa can be any naturally occurring amino acid
  misc_feature (531)..(531): Xaa can be any naturally occurring amino acid
  misc_feature (535)..(535): Xaa can be any naturally occurring amino acid
  unsure (1)..(562): unsure at all Xaa locations
XLREKXCLSLGKQTHQCPVPRPLTSTNLCHQDQFSQHRDLSLAPTCFTTGLNHIMLRATSSLVSMAQRLMHFRAFTILIAMLNLTLMKHHILLQSSIYLSRTLNLYQTTRPLILXSSMRMRXEXSFRSLSMLYLTMVMRSFLTCQGALTMSGMITLRQTMNGSIPXRILXAPTLQKRHHLSQASAVSTTMLEKRGTRNSCFLTAQKRYPKIASMKHSQSXQNYGRRWQFKENLLRDLRPISWRALLPHYSLQERASTGPXGARRPLLCTSFQPCRSSSKSAHASGXASWLLTMLFSKPAKAKMSCTSLTLTSTRVASTXLLSSSXRITVTSHAFXGXLVSMIQSQCTELLEDXMLLGSDXRSLQRTVRYGLSSGQWLLTLKIXRLECXVAVPERPSLLTLHSCCTTFLMKVSQLXTKGIGFSVWXRVSDQNXXRWWSRTQILTPPHSLPGSGRSMTTIRHFLIHWMPPFQGKAQIEXTWSASASHGKSSTSXLVKVLTVWKGMKWLGNGELEWQWRALCRPHLTAARLMAXDLYXNRTAISTGSRRSRTVSTLAGATRRSSS

SEQ ID NO: 11070 - protein, 350 aa, Zea mays
  misc_feature (2)..(2): Xaa can be any naturally occurring amino acid
  misc_feature (5)..(5): Xaa can be any naturally occurring amino acid
  misc_feature (8)..(8): Xaa can be any naturally occurring amino acid
  misc_feature (18)..(18): Xaa can be any naturally occurring amino acid
  misc_feature (66)..(66): Xaa can be any naturally occurring amino acid
  misc_feature (96)..(96): Xaa can be any naturally occurring amino acid
  misc_feature (112)..(112): Xaa can be any naturally occurring amino acid
  misc_feature (133)..(133): Xaa can be any naturally occurring amino acid
  misc_feature (142)..(142): Xaa can be any naturally occurring amino acid
  misc_feature (242)..(242): Xaa can be any naturally occurring amino acid
  misc_feature (245)..(245): Xaa can be any naturally occurring amino acid
  misc_feature (248)..(248): Xaa can be any naturally occurring amino acid
  misc_feature (287)..(287): Xaa can be any naturally occurring amino acid
  misc_feature (303)..(303): Xaa can be any naturally occurring amino acid
  misc_feature (307)..(307): Xaa can be any naturally occurring amino acid
  misc_feature (322)..(322): Xaa can be any naturally occurring amino acid
  misc_feature (330)..(331): Xaa can be any naturally occurring amino acid
  misc_feature (348)..(348): Xaa can be any naturally occurring amino acid
  unsure (1)..(350): unsure at all Xaa locations
LXAWXHVXRDDAGGGGGXLVGARFLADLRGRLRRPRQRRRRRRRVPPALQCRRRGGRGVFGAAGVXGDQPLLLLRLSRGLRRRRRRRRRIPLARLXGVVSASSPRRRQVDSXNPRVLRLRPPDGVPRHRLLRXLPPPATRRXGGDAVGGAAAVRGVRVRGRQDGGVPGAGAVGVPRRRLRFRLGVHPADGAAGAVHARMAHGRRHALGLPPLLLLPGPPARRRRRRRPRRPQGHRFHLCHGXSWXRAXSQAVHCGCSCNLGCNLWTSTDQRSTRFQDELPFSILSYXEGTCTCLLQYDGWGQXQERXQEIIAMFSLQRDCHXYISFCSCXXCYGHRRRLCHGGIGQEXAD

SEQ ID NO: 11071 - protein, 617 aa, Zea mays
  misc_feature (617)..(617): Xaa can be any naturally occurring amino acid
  unsure (1)..(617): unsure at all Xaa locations
PPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTWVNLPMAVGFMLLYTKLADVLSKEALFYAVIFPFIAFFGAFAYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRKNLGPGVDGWAISLKAMMSIVVVLGLVITGIYWGVNKFVIDNSSVPVVERKKKDKPKLSMGESMKVLLSSRYVRDLATLVVAYGISINLVEVTWKSKLKAQFPSPNEYSSFMGDFSTATGIATFTMMLLGRVILRKFGWGVAATITPAVLLLTGVGFFSLILFGEPLTPLMTKFGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDLQFSSLAKQELGREKLLKTQAVETVAEVVGTGNGSLQETLASEPSANGAATKQSQEPESTAPEKSGQQSQX

SEQ ID NO: 11072 - protein, 244 aa, Zea mays; identical to SEQ ID NO: 10437
  misc_feature (244)..(244): Xaa can be any naturally occurring amino acid
  unsure (1)..(244): unsure at all Xaa locations

SEQ ID NO: 11073 - protein, 226 aa, Zea mays; identical to SEQ ID NO: 10650
  misc_feature (226)..(226): Xaa can be any naturally occurring amino acid
  unsure (1)..(226): unsure at all Xaa locations

SEQ ID NO: 11074 - protein, 548 aa, Zea mays
  misc_feature (548)..(548): Xaa can be any naturally occurring amino acid
  unsure (1)..(548): unsure at all Xaa locations
MWLWTRQKSPPVGRRPPKVSSIRPLRATQSASPTQGWIASADELYSLLTVLVTRLATRHELRALRFPNAGCWPMAQHHGSHSLEVGGVGAGGVELDDDGHAARTGNLWTCFAHIITAVIGCGVLALSWSVAQLGWVGGPVAMLCFAFVTYLSAFLLSHCYRSPASDDGSLKRQRNYTYMDAVRTHLGEKRTWLCGLFQYLNMYGTAIAYTITTATCLRAIVRANCYHSQGHSAPCGAGGDHLYMLLFGAAQAVLSLIPNFHSMAWLSAVAAVMSFTYATIGLGLGLAKTIENGAIKGSVAGVPMSTAPQKVWRVAQAIGDIAFAYPYTIVLLEIQDTLKSPPPESETMQKGNVLAVLATTFFYLAVGCFGYAAFGNAAPGNLLTGFGFYEPYWLIDFANACIVLHLLGGYQMFSQQIFTFADRSLAARFPNSAFVNKSYAVKVPGAPASWSYSLNLQRLCFRTAYVASTTGLALLFPYFNEVLGVLGAVVFWPLAIYLPVEMYCVQRGVLPWTRTWVALQAFSVVCFVVGTFAFVGSVEGVIRKRLGX

SEQ ID NO: 11075 - protein, 273 aa, Zea mays
  misc_feature (273)..(273): Xaa can be any naturally occurring amino acid
  unsure (1)..(273): unsure at all Xaa locations
RRPRARVLTRPCSSPRLLYQSTSTPRPLRDRNRGAPPPSSAMAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDDVFKSNKGESKNKTKANDDTKKQQRPFLMQFFSPIFIKAFSITFFGEWGDKSQIATIGLAADENPFGVVLGGIIAQALCTTAAVLGGKSLASQISEKMVELSSGVLFLLFGIMSLLSGPGELX

SEQ ID NO: 11076 - protein, 157 aa, Zea mays
  misc_feature (157)..(157): Xaa can be any naturally occurring amino acid
  unsure (1)..(157): unsure at all Xaa locations
EGVGGNRKLRVSNFLGAEAMAGKGGKGLLAAKTTAAKSAEKDKGKKAPISRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKEX

SEQ ID NO: 11077 - protein, 595 aa, Zea mays
  misc_feature (595)..(595): Xaa can be any naturally occurring amino acid
  unsure (1)..(595): unsure at all Xaa locations
MDTLFRLVSLQASEQQQQQQSASYNSRSTTSSGSRSSSHQTNASYNYYYHSNSSGGGGGGQYYYGQQHPQQHQHQQYYLEPYQQEECGNTHHLYMDEDFSSSSSSRQHFHSHGAVVQPPTSSTATPTAPTPSLSTSSTAAGAAHALFEAADLSFPPDLNLDFSSPASSSGGGAASSAAVGGGGGGRWASQLLLECARAVAGRDSQRVQQLMWMLNELASPYGDVEQKLASYFLQGLFARLTASGPRTLRTLAAASDRNTSFDSTRRTALRFQELSPWSSFGHVAANGAILESFLEAAAASPEPQRLHILDLSNTFCTQWPTLLEALATRSADDTPHLSITTVVSSAPSAPTAAVQRVMREIGQRMEKFARLMGVPFSFRAVHHAGDLAGLDLDALDLRDGGATTALAINCVNSLRGVVPGGARRRDAFAASLRRLDPRVVTVVEEEADLVAFDPGAPEESGDTEAAFLKVFGEGLRFFSAYMDSLEESFPKTSNERLALERGAGRAIVDLVSCPASESMERRETAASWARRMRSSGFSPVAFSEDVADDVRSLLRRYREGWSMRDAGLDDSAAGAGVFLAWKEQPLVWASAWRPX

SEQ ID NO: 11078 - protein, 439 aa, Zea mays
ESLVKRTGTVWTAMAHIITAVIGSGVLSLAWSVAQLGWVGGPAAMVFFAGVTAVQSTLIADCYICHHPERGGVVRNRSYVDAVRIYLGDKSHLFCGFFLNLSLFGTGVVYTLTSATSMRAIRKANCYHREGHDAPCSVGGDGYYMLLFGLAQVLLSQIPNFHEMAGLSIFAAVMSCFYAFVGVGLGVAKVIANGVIMGGIGGIPLVSTTQKVWRVSQALGDILFAYPFSLVLLEIEDTLRSPPPESETMKKATRASIAITTLFYLCCGCFGYASFGDGTPGNLLTGFGFYEPYWLIDLANLAIVLHLLGGYQVYTQPVFAFADRKFGGGATVVEAPLLPVPGARRVNANVFRLCFRTAYVAATTALAVWFPYFNQIIGLLGSFTFWPLAVYFPVEMYLTRNKVAPWTNQWLAIHAFSLVCLLISAFASVGSAVGVFGSE

SEQ ID NO: 11079 - protein, 363 aa, Zea mays; identical to SEQ ID NO: 10039
  misc_feature (363)..(363): Xaa can be any naturally occurring amino acid
  unsure (1)..(363): unsure at all Xaa locations

SEQ ID NO: 11080 - protein, 360 aa, Zea mays
  misc_feature (360)..(360): Xaa can be any naturally occurring amino acid
  unsure (1)..(360): unsure at all Xaa locations
ALWCTGVSRPSSLTPSAATPSSILPDGAPGSRNKMSNRATHWCYACRRPIRLRGQDIVCPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDHX

SEQ ID NO: 11081 - protein, 158 aa, Zea mays
  misc_feature (158)..(158): Xaa can be any naturally occurring amino acid
  unsure (1)..(158): unsure at all Xaa locations
TAAAFRTAAPKPLSSFPSVSQLGTMMLANKLGGLLKNATSSNMSVYQAIRCMSSSKLFVGGLSYGTDDHSLRDEFAKYGQVIEAKIILDRESGRSRGFGFITYTSSEEASAAITAMDGKTLDGRNIRVNHANERTGGFRSSGGYGGGLFKMAQGFLKX

SEQ ID NO: 11082 - protein, 558 aa, Zea mays
  misc_feature (558)..(558): Xaa can be any naturally occurring amino acid
  unsure (1)..(558): unsure at all Xaa locations
PIRIRLLFLGAEEEGKEGRTAAAAAITTVRMHSTNLLLEEPIRMASILEPSKPSYFPAMTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDDX

SEQ ID NO: 11083 - protein, 343 aa, Zea mays
  misc_feature (343)..(343): Xaa can be any naturally occurring amino acid
  unsure (1)..(343): unsure at all Xaa locations
MAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAATNNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFNX

SEQ ID NO: 11084 - protein, 243 aa, Zea mays
  misc_feature (243)..(243): Xaa can be any naturally occurring amino acid
  unsure (1)..(243): unsure at all Xaa locations
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQAQAQQGQAVELEPEQQLDPRTQPAHDAEETAAEPPPAASNGTTDGGNKRKAAAMEEEGMLAVMTVAAPESSTKPRLSTTTSSLAVETX

SEQ ID NO: 11085 - protein, 231 aa, Zea mays
  misc_feature (231)..(231): Xaa can be any naturally occurring amino acid
  unsure (1)..(231): unsure at all Xaa locations
LVGFSCVTYYTSALLADCYRYPDPVHGAVNREYIDAVRCYLDRKNVVLCGCAQYVNLWGTLVGYTITASASMIAIKRVNCFHRDGYGAAGCNPSGSTYMVVFGLFQLLLSQLPSLLRTSSSSPPPTLPVAPLKLVLRTIVIMFTTLVAMLLPFFNAVLGLIGALGFWPLSVYFPVSMHMARLNIRRGEIRWWMLQAMSFVCLLISVAASIGSVHDIVHNLKAAAPFNTANX

SEQ ID NO: 11086 - protein, 153 aa, Zea mays
  misc_feature (153)..(153): Xaa can be any naturally occurring amino acid
  unsure (1)..(153): unsure at all Xaa locations
DVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRNX

SEQ ID NO: 11087 - protein, 180 aa, Zea mays
  misc_feature (180)..(180): Xaa can be any naturally occurring amino acid
  unsure (1)..(180): unsure at all Xaa locations
SLSAPPPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11088 - protein, 483 aa, Zea mays; identical to SEQ ID NO: 10000

SEQ ID NO: 11089 - protein, 183 aa, Zea mays; identical to SEQ ID NO: 10429
  misc_feature (183)..(183): Xaa can be any naturally occurring amino acid
  unsure (1)..(183): unsure at all Xaa locations

SEQ ID NO: 11090 - protein, 401 aa, Cuphea pulcherrima
  misc_feature (401)..(401): Xaa can be any naturally occurring amino acid
  unsure (1)..(401): unsure at all Xaa locations
EHEEGKNMRMESLLLNSFSPSPAGGKICRADTYKKAYFATARCNTLNSLNKNTGEYHLSRTRQRFTFHQNGHRTYLVKAVSGQSLESEPESYPNNRWDYVKSAADAFYRFSRPHTIIGTALSIVSVSLLAVEKLPELNSMFFTGLLEVILAALFMNIYIVGLNQLSDIDIDKVNKPYLPLASGEFSVGTGVTIVTSFLIMSFWLGWVVGSWPLFWALFISFVLGTAYSIDMPMLRWKRSAVVAALCILAVRAVIVQIAFFLHMQMHVYGRAAALSRPVIFATGFMSFFSIVIALFKDIPDIEGDKIFGIRSFTVRLGQERVFWICISLLEMAYAVAILVGSTSPYLWSKVITVSGHVVLASILWGRAKSIDFKSKAALTSFYMFIWKLFYAEYLLIPLVRX

SEQ ID NO: 11091 - protein, 407 aa, Cuphea pulcherrima
  misc_feature (407)..(407): Xaa can be any naturally occurring amino acid
  unsure (1)..(407): unsure at all Xaa locations
LVCGFCEHEEGKNMRMESLLLNSFSPSPAGGKICRADTYKKAYFATARCNTLNSLNKNTGEYHLSRTRQRFTFHQNGHRTYLVKAVSGQSLESEPESYPNNRWDYVKSAADAFYRFSRPHTIIGTALSIVSVSLLAVEKLPELNSMFFTGLLEVILAALFMNIYIVGLNQLSDIDIDKVNKPYLPLASGEFSVGTGVTIVTSFLIMSFWLGWVVGSWPLFWALFISFVLGTAYSIDMPMLRWKRSAVVAALCILAVRAVIVQIAFFLHMQMHVYGRAAALSRPVIFATGFMSFFSIVIALFKDIPDIEGDKIFGIRSFTVRLGQERVFWICISLLEMAYAVAILVGSTSPYLWSKVITVSGHVVLASILWGRAKSIDFKSKAALTSFYMFIWKLFYAEYLLIPLVRX

SEQ ID NO: 11092 - protein, 539 aa, Allium porrum
  misc_feature (539)..(539): Xaa can be any naturally occurring amino acid
  unsure (1)..(539): unsure at all Xaa locations
MGAYSVASPLCTWLVAACMSVTCNGERSLRSPSSLAFAPSKRSRSNKLVKRRGSNGQDSFGLVSAFCGSGIHFDSLISSLEPCEEFYRSLSFVSDPKKRRADKVMAVAVQPAKQVEEKKMTATKQRRVVVTGMGVVTPLGHEPDVFYNNLLEGVSGISEIENFDCKEYPTRIAGEIKSFSTDGWVAPKLSKRMDKFMLYMLTAGKKALADAGISEEILCELDKTKCGVLIGSAMGGMKVFNDAIEALRVSYKKMNPFCVPFATTNMGSAMLAMDLGWMGPNYSISTACATSNFCILNAANHIIRGEADLMLCGGSDAAIIPIGLGGFVACRALSERNSDPTKASRPWDSDRDGFVMGEGAGVLLLEELEHAKQRGAKIYAEFLGGSFTCDAYHLTEPHPEGTGVSLCIENALVESGVAREDVNYINAHATSTPAGDVKEYQALINSFGNNPKLRVNSTKSMIGHLLGASGAVEAVAAIQAIRTGWVHPNINLENPDRSVDTKFLVGSKKERLDVKVALSNSFGFGGHNSSILFGRYEQX

SEQ ID NO: 11093 - protein, 304 aa, Zea mays
PIPSSLLISISKSFRSSNRVSWRPLYQGYTNADSDPEPGRCRRTDGKKWRCSKEAMADHKYCERHINRNRHRSRKPVENQPKKTTKEVPAAAGSLPCAGPQGSLKKAKVNDSKPGTVSYWADSLNRTMLSREKANKPTEDSSLLLTSTNSQPTLSLLSQLKQQNKPDKLGPTLENESNPDTILKAWGGNQPSHKSISSTERHDAESLQSVLQNFSLAQNEKMESEKNKYSDSVLVSSTFYSADGPRATCLTPNMTQVKQDCISSSWEMPQGGPLGEILTNSKNSKDLSKCKPRSYGWLLNLDHA

SEQ ID NO: 11094 - protein, 168 aa, Zea mays
  misc_feature (168)..(168): Xaa can be any naturally occurring amino acid
  unsure (1)..(168): unsure at all Xaa locations
SPGFGFVGERIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYGGGNRGGGYGNSDGNWRNX

SEQ ID NO: 11095 - protein, 269 aa, Zea mays; identical to SEQ ID NO: 10272
  misc_feature (269)..(269): Xaa can be any naturally occurring amino acid
  unsure (1)..(269): unsure at all Xaa locations

SEQ ID NO: 11096 - protein, 165 aa, Zea mays
  misc_feature (165)..(165): Xaa can be any naturally occurring amino acid
  unsure (1)..(165): unsure at all Xaa locations
MASPSSSSFPSRKALSKIACRRLQKELTEWQVNPPAGFEHRVTDNLQRWVVDVAGAPGTLYTGETYKLQVDFSEHYPMEAPQVIFLHPAPMHPHIYSNGHICLDILYDSWSPAMTVSSICISILSMLSSSPAKQRPADNDRYVRNCRNGRSPKETTWWFHDDTVX

SEQ ID NO: 11097 - protein, 195 aa, Zea mays
  misc_feature (195)..(195): Xaa can be any naturally occurring amino acid
  unsure (1)..(195): unsure at all Xaa locations
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGGYGGGRRDGGYGGGGGYGGRREGGGGGYGGGGGYGVGARVAVAATAAVAAAAGGTDVWAHPGFGRVILSIYSIVLPFASVTVLVSVLPLDX

SEQ ID NO: 11098 - protein, 282 aa, Zea mays
  misc_feature (282)..(282): Xaa can be any naturally occurring amino acid
  unsure (1)..(282): unsure at all Xaa locations
RSKSSPAPAAPKSGNPLLRMDSGYNPRTVEEVFRDFKGRRAGIIRALTTDAEDFFKQCDPEKENLCLYGFPNESWEVNLPAEEVPPDLPEPALGINFARDGMQEKEWLSMVAAHSDAWLLSVAFYFGARFGFNKNDRKRLYSLIDDLPMAFEIVSGKSETKAPAPPSSSNHSNIKPKSNNKKKPPEPKVKQPKPRAPAEEGEEEDGSASEGEHGETLCGACKESYGPDEFWICCDLCEKWFHGKCVKITAAKAEHIKQYKCPSCTGGGGVGNGGTKRARPSX

SEQ ID NO: 11099 - protein, 83 aa, Zea mays
MKVKILQWHAVASWTWDAQDETCGICRMAFDGCCPDCKFPGDDCPLIWGVCNHAYHLHCILKWVNSQTSTPLCPMCRREWQFK

SEQ ID NO: 11100 - protein, 295 aa, Zea mays
  misc_feature (295)..(295): Xaa can be any naturally occurring amino acid
  unsure (1)..(295): unsure at all Xaa locations
VLLYHSIWLRVAGAGDSSSTDSPGGSLRRAHRDRGSTMAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKAX

SEQ ID NO: 11101 - protein, 400 aa, Zea mays
  misc_feature (400)..(400): Xaa can be any naturally occurring amino acid
  unsure (1)..(400): unsure at all Xaa locations
SSVSRLLLVPTHPHSQGRPLDSPSSPVQPDQSPSPPPQGAASRRSELESGPSSPHHKSGKGREVMGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSPX

SEQ ID NO: 11102 - protein, 703 aa, Zea mays
  misc_feature (703)..(703): Xaa can be any naturally occurring amino acid
  unsure (1)..(703): unsure at all Xaa locations
EGRLAMASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWTEKTTEKEISDDEDEEDKKDEEGKVEDVDEKEEKEKKKKKIKEVSHEWQLVNKQKPIWMRKPEDITKEEYAAFYKSLTNDWEEHLAVKHFSVEGQLEFKAVLFVPKRAPFDLFDTRKKPNNIKLYVRRVFIMDNCEELIPEWLSFVKGIVDSEDLPLNISRETLQQNKILKVIRKNLVKKCIELFFEIAENKEDYNKFYESFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADTDMPPLEDDAGESKMEEVDX

SEQ ID NO: 11103 - protein, 264 aa, Zea mays
  misc_feature (264)..(264): Xaa can be any naturally occurring amino acid
  unsure (1)..(264): unsure at all Xaa locations
MLLDHTVISSHLFYLVQHEGFAFVYMEDERDAEDAISRLDGIDFGRKGRRIRVEWTKEDRTVGRKSSSRRSPTNTKPTKTLFVINFDPINTRIRDLERHFDKYGRVANVRIKKNFAFIQFEVQEDATRALEGTNGSHFMDRVISVEYALRDDDEKGERGNGYSPDRRGRERSPGRRRSPSPYGRGRERGSPDYGRSKERGSPDYGRGGRSPDNGRGVSPAGGGRGDHARGGGRSPDYDRQRREASPPGYDRSPSRSPGREAREX

SEQ ID NO: 11104 - protein, 324 aa, Zea mays
  misc_feature (324)..(324): Xaa can be any naturally occurring amino acid
  unsure (1)..(324): unsure at all Xaa locations
MRTRYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRVFLANPDLPRRFEVDAPLNKYNRDTFYIPDPVIGYLTTHFFRQMYKCSLFSNLLFRLCSNWLVYQX

SEQ ID NO: 11105 - protein, 661 aa, Zea mays
  misc_feature (661)..(661): Xaa can be any naturally occurring amino acid
  unsure (1)..(661): unsure at all Xaa locations
FSPLCLLQFQAPPNQGEWEQREPHVSAPRWSRFSASRRGAAAVESQLSLRAPDPPGARSGSMGGEAPEPRRLTRALSIGGGGGGWVPDEMLQLVLGFVEDPRDREAASLVCRRWHRVDALSRKHVTVPFCYAVSPARLLARFPRLESLAVKGKPRAAMYGLIPDDWGAYARPWVTELAAPFECLKALHLRRMVVTDDDLAELIRARGHMLQELKLDKCTGFSTDGLRLVARSCSSLRTLFLEECQINDKGSEWIRDLAVNCPVLATLNFHMTELEVMPVDLELLAKSCKSLISLKIGDCDLSDLIGFFQSATSLEEFAGGTFNGQGELTKYGDVKFPSRICSLGLTFMGASEMPIIFPFAAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTMLRRFALYLRPGGLSDAGLGYIGQCSGNIQYMLLGNVGETDDGLISFALGCVNLRKLELRSCCFSERALALAILSMPSLRYVWVQGYKASQTGRDLMLMARPFWNIEFTPPSSQNAGRLIEDGEPCVDSHAQILAYGSLAGKRLDCPQSVVTLYPAX

SEQ ID NO: 11106 - protein, 153 aa, Zea mays
GGAMVGTGKRERIAIRRIDNLAARQVTFSKRRRGLFKKAEELSILCDAEVGLVVFSATGKLFHFASSSMKQVIDRYDSHSKTLQRSEPQSSQLQSHMDDGTCARLKEELAETSLKLRQMRGEELQRLSVEQLQELEKTLESGLGSVLKTKSQK

SEQ ID NO: 11107 - protein, 268 aa, Zea mays
PIEGFGVGRVVDSTHPGFSAGDVVSGMTGWEDYSLITNPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYKEEPDLTAALKRHFPEGIDIYFENVGGPMLDAVLLNMRVHGRIAVCGMVSQHGVTAPAGIHNLFSLISKRIAMKGFIQSDYVHLFPQFVDDITRHYRDGKIVYVEDMSVGLESGPASFVGLFSGKNVGKQVVCVSRD

SEQ ID NO: 11108 - protein, 224 aa, Zea mays
  misc_feature (224)..(224): Xaa can be any naturally occurring amino acid
  unsure (1)..(224): unsure at all Xaa locations
MARERREIRRIESAAARQVTFSKRRRGLFKKAEELAVLCDADVALVVFSATGRLSQFASSSVNDIVDKYSTHSKNLGKSHQQPSIDLNVEQSKYSGLNEQLAEETNGLRQMRGEDLEGLSVEELHRMERKLEAGLHRVISTKLFMQQIGELLQKGTQLEDENRRLKEQMPQVLTAGTMVVAAAAENILTEDGQSSESVMTALHSGSSLDCDDGSDISLKLSLPX

SEQ ID NO: 11109 - protein, 335 aa, Zea mays
TITTATSIRAILKANCYHEHGHDAHCDYDGNYYMLIFGGVQLLLSFIPDFHDMAWLSVVAAAMSFSYAFIGLGLGLARTIANGTIKGSITGVRMRTPMQKVWRVSQAIGDIAFAYPYSLILLEIQDTLKSPPAENKTMKRASMISILVTTFFYLCCGCLGYAAFGSDAPGNLLTGFGLYGPYWLIDFANACIILHLLGGYQVYSQPIFQFAERLLAERFPDSGFVNGGSYTVRFACLRACRVDPLRVCLRTLYVASTTAVAVALPYFNEVLALLGALSFWPLAIYFPVEMYFIQRNVRRWSARWVVLQTFSVVCLLVSAFALVGSIEGLISKKLG

SEQ ID NO: 11110 - protein, 111 aa, Zea mays
  misc_feature (111)..(111): Xaa can be any naturally occurring amino acid
  unsure (1)..(111): unsure at all Xaa locations
MAATKLQALWNHPAGPKTIHFWAPTFKWGISIANIADFAKPPEKISYPQQVAVTCTGLIWSRYSLVITPRNLNLLSVNVAMAGTGLYQLSRKIRQDYFSDEKDAAPQLEAX

SEQ ID NO: 11111 - protein, 286 aa, Zea mays
  misc_feature (286)..(286): Xaa can be any naturally occurring amino acid
  unsure (1)..(286): unsure at all Xaa locations
LRPDPTRHTNISTPVPATTTIWEEGKRMGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMYGTMASGGQAYHNHNGMGGGGYQYQYHHYHHAHKX

SEQ ID NO: 11112 - protein, 99 aa, Zea mays
EGDRIFGIRSFSVRLGQKKVFWICVGLLEMAYSVAILMGATSSCLWSKTATIAGHSILAAILWSCARSVDLTSKAAITSFYMFIWKLFYAEYLLIPLVR

SEQ ID NO: 11113 - protein, 177 aa, Brassica napus
  misc_feature (177)..(177): Xaa can be any naturally occurring amino acid
  unsure (1)..(177): unsure at all Xaa locations
LGTIYSVPPFRMKRFPVAAFLIIATVRGFLLNFGVYHATRAALGLSFQWSAPVAFITSFVTLFALVIAITKDLPDVEGDRKFQISTLATKLGVRNIAFLGSGLLLVNYISAISLAFYMPQVFRGSLMIPAHMILASCLVFQTWVLEKANYTKEAIAGYYRFIWNLFYAEYLLFPFFX

SEQ ID NO: 11114 - protein, 459 aa, Glycine max
  misc_feature (459)..(459): Xaa can be any naturally occurring amino acid
  unsure (1)..(459): unsure at all Xaa locations
SQANGVHSSKHDDDGRLKRRGTWLTATSHIVTAVIGSGVLSLAWAVAQLGWIAGPAILTIFSVITVFTSSLLSDCYRYPDSVHGTRNHNYREMVKNILGGRKYLFCGLAQFANLIGTGIGYTVTASISMVAVIRSNCFHKYGHEAKCHTSNYPYMTIFAVIQILLSQIPDFQELSGLSIIAAVMSFGYSSIGIGLSIAKIAGGNDAKTSLTGLIVGEDVTSQEKLWNTFQAIGNIAFAYAFSQVLVEIQDTLKSSPPENQAMKKATLAGCSITSLFYMLCGLLGYAAFGNKAPGNFLTGFGFYEPYWLVDIGNVFVFVHLVGAYQVFTQPVFQLVETWVAKRWPESNFMGKEYRVGKFRFNGFRMIWRTVYVIFTAVVAMILPFFNSIVGLLGAISFFPLTVYFPTEMYLVQAKVPKFSLVWIGVKILSGFCLIVTLVAAAGSIQGIIADLRIYEPFKX

SEQ ID NO: 11115 - protein, 301 aa, Glycine max
  misc_feature (301)..(301): Xaa can be any naturally occurring amino acid
  unsure (1)..(301): unsure at all Xaa locations
RCGFSFSLLRLSLGALNLNYSSCESTSQENSQAMDPKLKEVSQLFDRFKASFIRNDFDTCSNLLSQLKVLLTGFRSLPPLFADTPNAVHELTIARDIYEHAVVLSVKNEDQDAFERDFFQLKPYYTDACNRLPPSPQEYPILGLNLLRLLVQNRIAEFHTELELLSSAALENPCIKHAVELEQSFMEGAYNRVLSARQTVPHDTYVYFMDLLAKTVRDEIAGCSEKAYDYLSIKDAKQMLLFSSDQELLEYIKEEHPEWEIKNGSVFFQKAKESAPCKEIPSLQLINQTLSYARELERIVX

SEQ ID NO: 11116 - protein, 377 aa, Oryza sativa
  misc_feature (377)..(377): Xaa can be any naturally occurring amino acid
  unsure (1)..(377): unsure at all Xaa locations
HPPGGRSGATSHLTYCFRQPPPDTMADSPSPRLDEEDAFGRDFNSSPSPTAPPARSGEKRPFGDLDDDDEDVFASKKGKTKVEESAPGAATGMILSLRESLQNCKDNLASCQVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVETX

SEQ ID NO: 11117 - protein, 238 aa, Oryza sativa
  misc_feature (238)..(238): Xaa can be any naturally occurring amino acid
  unsure (1)..(238): unsure at all Xaa locations
GFSLLFSLSHRLLVRFPSRRSRGGGGGGGADMAEVEAAPIAAAETPEVAAAEGAAAAKAPHKLHRQWAFWYDIQSKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNVX

SEQ ID NO: 11118 - protein, 539 aa, Allium porrum; identical to SEQ ID NO: 11092
  misc_feature (539)..(539): Xaa can be any naturally occurring amino acid
  unsure (1)..(539): unsure at all Xaa locations

SEQ ID NO: 11119 - protein, 631 aa, Zea mays
  misc_feature (631)..(631): Xaa can be any naturally occurring amino acid
  unsure (1)..(631): unsure at all Xaa locations
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEASAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAPX

SEQ ID NO: 11120 - protein, 239 aa, Oryza sativa
  misc_feature (239)..(239): Xaa can be any naturally occurring amino acid
  unsure (1)..(239): unsure at all Xaa locations
YEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQX

SEQ ID NO: 11121 - protein, 261 aa, Oryza sativa; identical to SEQ ID NO: 11033
  misc_feature (261)..(261): Xaa can be any naturally occurring amino acid
  unsure (1)..(261): unsure at all Xaa locations

SEQ ID NO: 11122 - protein, 162 aa, Oryza sativa
  misc_feature (162)..(162): Xaa can be any naturally occurring amino acid
  unsure (1)..(162): unsure at all Xaa locations
MTSSSSPSRKVLSKIACNRLQKELAEWQVNPPSGFKHKVTDNLQRWVIEVAGAAGTLYAGETYQLQVDFPEHYPMEAPQVIFLHPAPMHPHIYSNGHICLDILYDSWSPAMTVSSVCISILSMLSSSPAKQRPADNDRYVRNCRNGRSPKETRWWFHDDKVX

SEQ ID NO: 11123 - protein, 134 aa, Oryza sativa
  misc_feature (134)..(134): Xaa can be any naturally occurring amino acid
  unsure (1)..(134): unsure at all Xaa locations
GLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANAX

SEQ ID NO: 11124 - protein, 263 aa, Oryza sativa
  misc_feature (263)..(263): Xaa can be any naturally occurring amino acid
  unsure (1)..(263): unsure at all Xaa locations
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQX

SEQ ID NO: 11125 - protein, 269 aa, Oryza sativa
  misc_feature (269)..(269): Xaa can be any naturally occurring amino acid
  unsure (1)..(269): unsure at all Xaa locations
RRLGNSFASATTMKLAVVAVAALLLAAGVASADEFDFFYLVQQWPGSFCDTQAGCCFPDTGKPAAEFGIHGLWPNYAKCRPAAGAVADDDDGVVEMVVDGGAAVERHHRRRQKCWPEYCDDGNKLRPWEIKDLVAELDANWPTLSCKGGKSFEFWSYEWKKHGTCSGMGQHGYFAAALELKKRHDLAAVLAGAGIVPSDDESYSLGSIRDAIAAATGAVPNLECNRDAAGETQLFQVYQCVDRSGKKLVDCQLPMQGKCRDKVKLPTFX

SEQ ID NO: 11126 - protein, 272 aa, Oryza sativa
  misc_feature (272)..(272): Xaa can be any naturally occurring amino acid
  unsure (1)..(272): unsure at all Xaa locations
PRRRRLGNSFASATTMKLAVVAVAALLLAAGVASADEFDFFYLVQQWPGSFCDTQAGCCFPDTGKPAAEFGIHGLWPNYAKCRPAAGAVADDDDGVVEMVVDGGAAVERHHRRRQKCWPEYCDDGNKLRPWEIKDLVAELDANWPTLSCKGGKSFEFWSYEWKKHGTCSGMGQHGYFAAALELKKRHDLAAVLAGAGIVPSDDESYSLGSIRDAIAAATGAVPNLECNRDAAGETQLFQVYQCVDRSGKKLVDCQLPMQGKCRDKVKLPTFX

SEQ ID NO: 11127 - protein, 700 aa, Oryza sativa
  misc_feature (700)..(700): Xaa can be any naturally occurring amino acid
  unsure (1)..(700): unsure at all Xaa locations
MASETETFAFQAEINQLLSLIINTFYSNKEIFLRELISNSSDALDKIRFESLTDKSKLDAQPELFIHIVPDKASNTLSIIDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENAIMDELRKRADADKNDKSVKDLVMLLFETALLTSGFSLEDPNTFGTRIHRMLKLGLSIDEDESAEADADMPPLEDDAGESKMEEVDX

SEQ ID NO: 11128 - protein, 483 aa, Oryza sativa
  misc_feature (483)..(483): Xaa can be any naturally occurring amino acid
  unsure (1)..(483): unsure at all Xaa locations
QRVKFEGFTEPLTMAPQLPLEVASAPKLDDDGHPQRTGNLWTCVAHIITAVIGCGVLALSWSVAQLGWVAGPIAMVCFAFVTYISAFLLSHCYRSPGSEKMQRNYSYMDAVRVHLGRKHTWLCGLLQYLNLYGIGIAYTITTATCMRAIKRANCYHSEGRDAPCDSNGEHFYMLLFGAAQLLLSFIPNFHKMAWLSVVAAIMSFAYSTIGLGLGLAKTIGDGTVKGNIAGVAMATPMQKVWRVAQAIGDIAFAYPYTIVLLEIQDTLRSPPPESETMQKGNVIAVLATTFFYLCVGCFGYSAFGNAAPGNLLTGFGFYEPYWLIDFANACIVLHLLGGYQMFSQQIFTFADRCFAASFPNSAFVNRSYSVKILPWRRGGGGGGAGRYEVNLQRVCFRTVYVASTTGLALVFPYFNEVLGVLGALVFWPLAIYLPVEMYCVQRRISPWTPRWAALQAFSVVCFVVGTFAFVGSVEGVIRKRLGX

SEQ ID NO: 11129 - protein, 236 aa, Sorghum bicolor
  misc_feature (236)..(236): Xaa can be any naturally occurring amino acid
  unsure (1)..(236): unsure at all Xaa locations
QTSLPRLVSSLPHPKKTLEKRRRRDMAEVEVPAAAVATTIPEAAEATEGGAAAEAKGPHKLHRQWTFWYDIQSKPKPGAAWGTSLKKAYTFDTVEEFWSLYDQIFRPSKLSGNADFHLFKAGVEPKWEDPECANGGKWTVPCNRKATFENMWLETLMALIGEQFDETEDICGIVASVRARGDKLALWTRTASNEAVQVNIGKKWKDVIDYNDKITYTFHDDSRREKPSRGGRYTVX

SEQ ID NO: 11130 - protein, 717 aa, Sorghum bicolor
  misc_feature (717)..(717): Xaa can be any naturally occurring amino acid
  unsure (1)..(717): unsure at all Xaa locations
MASADVHMAGGGAETETFAFQAEINQLLSLIINTFYSNKEIFLRELISNASDALDKIRFESLTDKSKLDAQPELFIRLVPDKATKTLSIIDSGVGMTKSDLVNNLGTIARSGTKEFMEALAAGATDVSMIGQFGVGFYSAYLVADKVVVTTKHNDDDQYVWESQAGGSFTVTLDTTGERLGRGTKITLFLKDDQLEYLEERRLKDLVKKHSEFISYPIYLWTEKTTEKEISDDEDDEDKKEGDVEEVDDDDGDKDDKDSKTTKKKKKVKEVTHEWVQINKQKPIWLRKPEEITREEYASFYKSLTNDWEDHLAVKHFAVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDEMTSLKDYVTRMKEGQKDIYYITGESKKAVENSPFLERLKKKGYEVLFMVDAIDEYAVGQLKEYDGKKLVSATKEGLKLDDDDEEAKKRREERKKQFEDLCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDEDAAADEDADMPALEEGAAEESKMEEVDX

SEQ ID NO: 11131 - protein, 205 aa, Zea mays
  misc_feature (205)..(205): Xaa can be any naturally occurring amino acid
  unsure (1)..(205): unsure at all Xaa locations
SHQLPMAATAMDHDGGDDVVTPGELLGNSLTLAAGRGAYADGRSVRASVTGRRRIVPPAPASDDQRSTVEVVGHKAHGAVPQPGSVVIARVTKVMARMASADIMCVDSKAIREKFTGMIRQQDVRATEIDKVDMYQSYRPGDIVKAMVLSLGDARAYYLSTAKNELGVVSAQSIAGGTLVPISWTEMQCDLTGQIEQRKVAKVEX

SEQ ID NO: 11132 - protein, 288 aa, Zea mays; identical to SEQ ID NO: 10810
  misc_feature (288)..(288): Xaa can be any naturally occurring amino acid
  unsure (1)..(288): unsure at all Xaa locations

SEQ ID NO: 11133 - protein, 274 aa, Zea mays
  misc_feature (274)..(274): Xaa can be any naturally occurring amino acid
  unsure (1)..(274): unsure at all Xaa locations
IRRPRARVLTRPCSSPRLLYQSTSTPRPLRDRNRGAPPPSSAMAPSLLGGFTKSLAMTVLSEVGDKTFFAAAILAMRHPRKLVLAGCLTALIVMTALSASLGWVAPNLISRKWTHHVTTLLFFVFGIWSLWEGFKEDGDSEELAEVEAELDDVFKSNKGESKNKTKANDDTKKQQRPFLMQFFSPIFIKAFSITFFGEWGDKSQIATIGLAADENPFGVVLGGIIAQALCTTAAVLGGKSLASQISEKMVELSSGVLFLLFGIMSLLSGPGELX

SEQ ID NO: 11134 - protein, 581 aa, Zea mays
  misc_feature (581)..(581): Xaa can be any naturally occurring amino acid
  unsure (1)..(581): unsure at all Xaa locations
MEQRNVLALGEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNILYEAVGENISGPSFHLNEYSSGTIQATGKPNDCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPRLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAEX

SEQ ID NO: 11135 - protein, 340 aa, Zea mays
  misc_feature (340)..(340): Xaa can be any naturally occurring amino acid
  unsure (1)..(340): unsure at all Xaa locations
MVRVGLSSAPGVNLTEQIDNVFDQLINKIEHADFDTRPFLKQLNVLGRYEPIKRNVYCTKRRIEDYGISCHCKPSPGSSVVCGRDCHCGMLFSCCSSQCECDDTCTNKSFQHRPLKKTKLIKTEKCGHGLVAEDEIKKGEFVIEYVGEVIDDRTCENRLWTMKRLLDTDFYLCEVSSNMVIDATNKGNRSRFINHSCEPNTAMQKWTVDGETRVGIFALRDIKIGEELTYDYKFVQFGAAQVCHCGSSNCRKMLGTTKYSGSSQNHHAKKKKRKTSCENCIQQFLRLWHPHKKMYVGCWIIDFDQETKMHTLKFNDLHTEKFNLKEEEWHFLEVDFDEDX

SEQ ID NO: 11136 - protein, 245 aa, Zea mays
  misc_feature (245)..(245): Xaa can be any naturally occurring amino acid
  unsure (1)..(245): unsure at all Xaa locations
SKGTLAMSAASKKLFQAARSLVLSASHRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 11137 - protein, 279 aa, Zea mays
  misc_feature (279)..(279): Xaa can be any naturally occurring amino acid
  unsure (1)..(279): unsure at all Xaa locations
MTMATKAACVLAVWVLVASGLCDLGSARAPLGSKPQREFDYFALSLQWPGTICASTRHCCATNGCCRSEPLQTFTIHGLWPDYDDGTWPSCCRRTQFEMDKILPLKEVLDKYWPSLYCSKSGTCFSGKGLFWAHEWEKHGTCSAPVVQDELQYFTLALDLYSKYNVTEMLSSGGIQVSNGKEYALSDVIDTIKHAFGGSPQIVCKRGSIEELRLCFDKELKPRDCLTTSLANGSVSKSKHCPRYITLPTYDPLVLANSTVEIMTQFDEFDVPAALYTAX

SEQ ID NO: 11138 - protein, 595 aa, Zea mays
IAVMSADSRTDIVMKGIKHGACDYLIKPVRMEELKNIWQHVVRKKFNGNKDHEHSGSLDDTDRNRPTNNDNEYASSANDGGDGSWKSQKKKREKEDDETDLESGDPSTSKKPRVVWSVELHQQFVNAVNHLGIDKAVPKKILELMNVPGLTRENVASHLQKFRLYLKRIAQHHAGIPHPFVASASSAKVAPLGGLEFQALAASGQIPPQALAALQDELLGRPTSSLALPGRDQSSLRLAAIKGNKPHGEREIAFGQPIYKCQNNTYGAFSQSSPAVGGLPSFAAWPNNKLGMTDSSNTLGNVGNSQNSNMLLHELQQQPDTLLSGTLHNIDVKPSGVVMPSQSLNVFPASEGISHNQNPLVIPSQSPSFLASVPPSMKHESLLGSPSPSTSLLGGLDMVNQASTSQPLISSHGANLPGLMNRSSNAMPSPGISNFQSGNIPYVVTQNAMGVSSRPPGVLKTECTESLTHSYGYIGGSTSVDSSLLSSQAKNPQYGLLQSQNDVSSSWLSSQDFDSFGNSLGQGHPGSTSSSFQSSALGKLPDQGRGRNHGFVGKGTCIPSRFAVDEVGSPTNLSHNIVNSGDIVNPDIFGFSGQM

SEQ ID NO: 11139 - protein, 397 aa, Zea mays
  misc_feature (46)..(46): Xaa can be any naturally occurring amino acid
  misc_feature (53)..(53): Xaa can be any naturally occurring amino acid
  misc_feature (76)..(76): Xaa can be any naturally occurring amino acid
  misc_feature (87)..(87): Xaa can be any naturally occurring amino acid
  misc_feature (96)..(96): Xaa can be any naturally occurring amino acid
  misc_feature (98)..(98): Xaa can be any naturally occurring amino acid
  misc_feature (101)..(101): Xaa can be any naturally occurring amino acid
  misc_feature (145)..(145): Xaa can be any naturally occurring amino acid
  misc_feature (178)..(178): Xaa can be any naturally occurring amino acid
  misc_feature (183)..(183): Xaa can be any naturally occurring amino acid
  misc_feature (285)..(285): Xaa can be any naturally occurring amino acid
  misc_feature (309)..(309): Xaa can be any naturally occurring amino acid
  misc_feature (339)..(339): Xaa can be any naturally occurring amino acid
  unsure (1)..(397): unsure at all Xaa locations
RRGPLPPRPRDGRASPTAVPPPRAARRGPPARSFSTTMLFHTTKWXRTNLLFXPKDPRSYLASPSEILRMEILLLXDITSVIKYFCXCFGATAAVXTXNTXFYNHLEGNIIFSRCILQIFPATYCHRNSIKHSLSFPSSCPELVXYITFVPHWFAGGSGSCPFHEYLYCWTEPVIRHXDRQGXQANSSIGIWGIHPCNWGCNSFGLCRYELWPWMGCWITTSVLGSFHKLCSWDCIFNQSAVPSMEEICCCCSTVHISSSCSDCSAGLFSPHSDFCFQETGSVFXAIIICNWIYDVLLCCNSTIQGYTXHRRGPHIRDPILQRPVRAKEGLLDLRWLAXDGLQRCDTDGSYLFLFVEQNSNHRWPFHTCRDPMELRAIGGLDEQSRNNVLLHVHLEA

SEQ ID NO: 11140 - protein, 457 aa, Zea mays
  misc_feature (457)..(457): Xaa can be any naturally occurring amino acid
  unsure (1)..(457): unsure at all Xaa locations
MSFRSIVRDVRESFGSLSRRSLEVRISGLPGLSGGHHRGKSVGSVSDLRDRPVVVDQSRWVGLPPELLRDVMRRLEEGESNWPSRKNVVACAAVCGTWREICKDIVLSPEFCGKLTFPVSLKQPGPRNGIIQCFIKRDKSTSTYYLYLCLSPVVLSEDGKFLLAAKRNRRTTYTEYIISVDPKSISRSSDGCVGKMRSNFLGTKFIVHDTRAPHNAGSLVSCERGSRRISSRRVSPKVPTASYPIARVNYELNLLGTRGPRRMNCTMHSIPASTLDPQGMVPEPGQPKQIFVPGSSSFEDSFRSANNTPSSSRFSVADRSLDWSSSRFSETSGLAQQDDDDSDQAKERPLVLCNKEPRWHEQLQCWCLNFHGRVTVASVKNFQLIAAPQLDSEPSQQAQQQTQPSNSSSASDHDKVILQFGKVANDMFTMDYRYPLSAFQAFAICLTSFDSKLACEX

SEQ ID NO: 11141 - protein, 359 aa, Zea mays
  misc_feature (359)..(359): Xaa can be any naturally occurring amino acid
  unsure (1)..(359): unsure at all Xaa locations
WLSSASRSSLGAAVGGEAKVTPEADPAAQHDEADEERWSRLLPELLTEIMRRVDAGAERWPPRRDVVVCACVCRRWRDAAVSVVRPPLECGRITFPSSLKQPGPRDAPMHCFIRRDKKISTFSLYLSLTQALTDKGKFLLAARRFRQGAHTEYIISYDYDDLHPRSSSYVGKLRSDFLGTKFIIYDTQAPYDGAKPSRTRSTRRFASKQISPQVSGGNFEVGQVTYRFNFMKSRGPRRMQCNIQCPVGQGSASDPSKEKTPSPSSLDLKNKAPRWHDHLQCWCLNFHGRVTVASVKNFQLVATAGSGGPWGVGDEETVILQFGKIEDDAFTMDYRQPLSAFQAFAICLTSFGTKLACEX

SEQ ID NO: 11142 - protein, 138 aa, Zea mays
RADGRNPNQLRPFTCTGNPLHRAHGSARWAQGDTVVLAAVYGPKSGTRKGENPEKASIEVVWKPKTGQIGTLLFPSSSLRPTAARVTGSLKWRVVFAGRQEREYEMTLKRTLQSICLLTVHPNTTSVVLQVVGDDGSV

SEQ ID NO: 11143 - protein, 485 aa, Zea mays
  misc_feature (485)..(485): Xaa can be any naturally occurring amino acid
  unsure (1)..(485): unsure at all Xaa locations
SAAGPAAASSPSLSLSLAISIPLGTQAPPQTQSFSSQKMQEQDVDDGGGRTTQQQEKSIDDWLPINSSRKAKWWYSAFHNVTAMVGAGVLGLPYAMSELGWGPGIAVMILSWIITLYTLWQMVEMHEMVPGKRFDRYHELGQHVFGDRLGLWIVVPQQLAVEVSLNIIYMVTGGQSLKKFHDVICDGGRCGGDLKLSYFIMIFASVHLVLSQLPNFNSISAVSLAAAVMSLSYSTIAWGASLHRGRREDVDYHLRATTTPGKVFGFLGGLGDVAFAYSGHNVVLEIQATIPSTPDKPSKKAMWKGAFVAYVVVAICYFPVTFVGYWAFGSGVDENILITLSKPKWLIALANMMVVVHVIGSYQVYAMPVFDMIETVLVKKMRFAPSLTLRLIARSVYVAFTMFLGITFPFFGGLLSFFGGLAFAPTTYFLPCIMWLKVYKPKRFGLSWFINWICIVIGVLLLILGPIGGLRQIILSATTYKFYQX

SEQ ID NO: 11144 - protein, 238 aa, Zea mays
  misc_feature (238)..(238): Xaa can be any naturally occurring amino acid
  unsure (1)..(238): unsure at all Xaa locations
MSGSASRKLFQAARSIVLSASQRSSFSVLAAEGRTAALANFGRKILPSACSYHRQGSHAASGWGAIAAAVPAAVYMLQDQEAHAAEMERTFIAIKPDGVQRGLISEIVNRFERKGYKLVAIKLIVPSKGFAEKHYHDLKERPFFNGLCDFLSSGPVLAMVWEGEGVIKYGRKLIGATDPQKSEPGTIRGDLGVVVGRNIIHGSDGPETAKDEIALWFEPKELVSYTSNAEKWVYGVNX

SEQ ID NO: 11145 - protein, 377 aa, Zea mays
  misc_feature (377)..(377): Xaa can be any naturally occurring amino acid
  unsure (1)..(377): unsure at all Xaa locations
KPRADPNEPEPFQTLSSPPLPPKHHRAPMAKYGEGDKRWIVEERADGTNVHNWHWAERDCLEWSRARLSSLLAGLTILDGEGGLSLRTVALDKLDGEAYVNIRKGKVIPGYELSLTLSWEAEAASESGAAKVTGTAEVPYLADENADEDPDLRVTVRGDETPLALRAKDAFLSRGKPMVLEKIREFVAAMAKGGPAKDELDSKKTPTKVAGSAPAKEAVLAPAPAVEKKKAKGKDKEGFKTIEMTEKFYCRSKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGIX

SEQ ID NO: 11146 - protein, 249 aa, Zea mays
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGQSSWKNAWKKAGACSGLSEKDYFETALSFRSRINPLVRLKAKGIEPDFGLYGLKAITKVFKSGINATPVIQCSKGPFDKYMLFQLYFCAAGNGTFIDCPAPQQYTCSKEILFHPFKKWMLKQQLNQDDDPFQLPGVA

SEQ ID NO: 11147 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11148 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11149 - protein, 167 aa, Zea mays; identical to SEQ ID NO: 10847
  misc_feature (167)..(167): Xaa can be any naturally occurring amino acid
  unsure (1)..(167): unsure at all Xaa locations

SEQ ID NO: 11150 - protein, 99 aa, Zea mays
DLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 11151 - protein, 296 aa, Zea mays
VVFSQIPDFDQIWWLSIVAAVMSFTYATIGLVLGIMQTVANGGFQGSLTGISIGAGVTPTEKVWRSLQAFGNIAFAYSYSIILIEIQDTVKAPPPSEAKVMKRATMVSVATTTVFYMLCGCMGYAAFGDAAPDNLLTGFGFYEPFWLLDIANVAIVVHLVGAYQVFCQPLFAFVEKWAAATWPDSAFIAREFRVGPFALSLFRLTWRTAFVCLTTVAAMLLPFFGDVVGLLGAVSFWPLTVYFPIEMYVVQRAVRRWSTHWICLQMLSAACLLVSVAAAAGSIADVIGALKVYRPF

SEQ ID NO: 11152 - protein, 216 aa, Oryza sativa
  misc_feature (216)..(216): Xaa can be any naturally occurring amino acid
  unsure (1)..(216): unsure at all Xaa locations
MASQQERASYHAGETKARAEEKTGRMMGTAQEKAREAKDTASDAAGRAMGRGHGAKEATKEKAYETKDATKEKAYEAKDAASDATGRAMDKGRGAAGATRDKAYDAKDRAADTAQSAADRARDGAGQTGSYIGQTAEAAKQKAAGAAQYAKETAIAGKDKTGAVLQQAGEQVKSVAVGAKDAVMYTLGMSGDNKNNAAAGKDTSTYKPGTGSDYQX

SEQ ID NO: 11153 - protein, 415 aa, Oryza sativa
  misc_feature (415)..(415): Xaa can be any naturally occurring amino acid
  unsure (1)..(415): unsure at all Xaa locations
QKPVEASEAARRGAGRGRRPERRGRRRRPAGRASGSTPTAMALLMDPGAGGPLTESEKADLDAIAAIKESAAAEYKEKGNRLVKMGRSHYADAVDCYTKAIAQMEPLPPPPVPSPDASVLFANRAHVNLLLGNHRRALDDAARAVQLSPSNVKAYYRAAKAAIALGLLPEAAAFCRRGIEQDPANEELKKLLAQVDAQQSEQDRHRAKVAQAVSAAKDIVAAIEKRGLKLGKAAYQELTGVKKPKLDEQGVLHWPVLLLYPEVMSSDFIEDFPETDTFVPHLDVMFSESSPPLPWDDKHAYTRDAVELYYQAGVGTVLSKSEILKILLEGTMDSKSLPESLLDEEDGENDDGKSSTITSSDKGSVKWINVKEGKTLQEVLQHKDFIIPAIPVFFVVSRKSTFYRKFKAGNWSLPX

SEQ ID NO: 11154 - protein, 196 aa, Oryza sativa
  misc_feature (196)..(196): Xaa can be any naturally occurring amino acid
  unsure (1)..(196): unsure at all Xaa locations
DQASYRAGETKAHTEEKAGQVMGASKDKASEAKDRASEAAGHAAGKGQDTKEATKEKAQAAKERASETAQAAKDKTSSTSQAARDKAAESKDQTGGFLGEKTEQAKQKAAETAGAAKQKTAETAQYTKDSAIAGKDKTGSVLQQASEQVKSTVVGAKDAVMSTLGMTEDEAGTDDGANKDTSATAAATETTARDHX

SEQ ID NO: 11155 - protein, 223 aa, Zea mays; identical to SEQ ID NO: 10692
  misc_feature (223)..(223): Xaa can be any naturally occurring amino acid
  unsure (1)..(223): unsure at all Xaa locations

SEQ ID NO: 11156 - protein, 329 aa, Zea mays
  misc_feature (329)..(329): Xaa can be any naturally occurring amino acid
  unsure (1)..(329): unsure at all Xaa locations
EPTAMSATATDEAAVEARLQELRGRLGKKQHFEEAVNELAAAVRDRYAGASPALRKAMYSTVCRVATVLQTRYTAPGFWHVGLNLFVGIEKLVSNPAEKEHLKTCISRAREHLDEKENEDSVPSNREADTRFLFEGHLTVGQEPPPPAWLVAQNLTRELSILTESSGDQDGSNNRTVPRAEEITPAIMNLLETISGDRDLETALEESLQGIIEYPQRAPPASKEVVANLPVIAVTEEVMSRLGSETECAVCRENLVVDDKMQELPCKHLFHPLCLKPWLDENNSCPICRHELRTDDHVYESRKEREREEEEDRRGAANAVRGGEFIYIX

SEQ ID NO: 11157 - protein, 156 aa, Zea mays
  misc_feature (156)..(156): Xaa can be any naturally occurring amino acid
  unsure (1)..(156): unsure at all Xaa locations
ASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGGGGGYGGGGGGYGGGNRGGGYGNSDGNWRNX

SEQ ID NO: 11158 - protein, 269 aa, Zea mays; identical to SEQ ID NO: 10272
  misc_feature (269)..(269): Xaa can be any naturally occurring amino acid
  unsure (1)..(269): unsure at all Xaa locations

SEQ ID NO: 11159 - protein, 133 aa, Zea mays
  misc_feature (133)..(133): Xaa can be any naturally occurring amino acid
  unsure (1)..(133): unsure at all Xaa locations
MASRMGMVAILSLFVCALVASTSVNANVWQTDEDAFYSTNKLGVNGNMEMAQQQGGFIGHRPRLALFNRASKQLDREKRPVPSGPDPIHHSIPSHAPQHPPSYGKAPYEDDKSIASPGLSNPIGPPPFLDRYX

SEQ ID NO: 11160 - protein, 274 aa, Zea mays
NADSDPEPGRCRRTDGKKWRCSKEAMADHKYCERHINRNRQRSRKPVENQPKKTTKEVPAAAGSLPCAGPQGSLKKAKVNDSKPGIVSYWADSLNRTMLSREKANKPTEDSSLLLTSTNSQPTLSLLSQLKQQNKPDKLGPTLENESNPDTILKAWGGNQPSHKSISSTERHDAESLQSVLQNFSLAQNEKMESEKNKYSDSVLVSSTFYSADGPRATCLTPNMTQVKQDCISSSWEMPQGGPLGEILTNSKNSEDLSKCKPRSYGWLLNLDHA

SEQ ID NO: 11161 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11162 - protein, 585 aa, Zea mays
  misc_feature (34)..(34): Xaa can be any naturally occurring amino acid
  misc_feature (55)..(55): Xaa can be any naturally occurring amino acid
  misc_feature (63)..(63): Xaa can be any naturally occurring amino acid
  misc_feature (76)..(76): Xaa can be any naturally occurring amino acid
  misc_feature (101)..(101): Xaa can be any naturally occurring amino acid
  misc_feature (109)..(109): Xaa can be any naturally occurring amino acid
  misc_feature (133)..(133): Xaa can be any naturally occurring amino acid
  misc_feature (141)..(141): Xaa can be any naturally occurring amino acid
  misc_feature (147)..(147): Xaa can be any naturally occurring amino acid
  misc_feature (180)..(180): Xaa can be any naturally occurring amino acid
  misc_feature (201)..(202): Xaa can be any naturally occurring amino acid
  misc_feature (215)..(215): Xaa can be any naturally occurring amino acid
  misc_feature (256)..(256): Xaa can be any naturally occurring amino acid
  misc_feature (289)..(290): Xaa can be any naturally occurring amino acid
  misc_feature (307)..(307): Xaa can be any naturally occurring amino acid
  misc_feature (309)..(309): Xaa can be any naturally occurring amino acid
  misc_feature (323)..(323): Xaa can be any naturally occurring amino acid
  misc_feature (335)..(335): Xaa can be any naturally occurring amino acid
  misc_feature (467)..(467): Xaa can be any naturally occurring amino acid
  misc_feature (491)..(491): Xaa can be any naturally occurring amino acid
  misc_feature (568)..(568): Xaa can be any naturally occurring amino acid
  unsure (1)..(585): unsure at all Xaa locations
YILQSLCHGTVYNTDNYQKWRDYKLNPSTTGSSXVKYSPTGGAIGEHTNEHHPCXHKGMVERXGQMRHLCKQASVXQWELHGFTAKLYIIIIPIILQSRYXHCIIALIXIDAVQSFIPEGDTLKLIAGQVFRXTSKISAAXYTCLFXSKQNSSVPFLIKVTIFNAGQPLHAGKLPVTVSXGHNTVTKLSRNRLNCTCQCWXXGLHTAKKIWFYIXEVSDIFLHIVTHRNYWRWGIQMTRGNWVLQVRFRQARIVSXKVAALMVMLWILHELLWWHTSTPGLTFQDHGFXXLPVLIHWHSFKREHPTXRXSSGDIVRVNSITCXNSIFIWHLQGHXSLRVVQMRIENVGLSFDLLRTMLTSIGKVAWLLLEGTSEVKMIRWSLLIEILPSSTHYPFLVLLLQPTQVEAVFLKMTGHILSCQARNIHKIQYFLRPDFVKSNLVDSIYKFLVKVNRPDNSSLLNSSSITXVLICMVLIHVFSLPHSIRVSSHKXVPLVESLYTISKHLEIIIAVITFNLFHLMHFFPIHMLPNVSEFLHPNRLEEVVTCTMLDTFHHPTCLSVYGHHYNRXIHLKPNEFEKLETIHVR

SEQ ID NO: 11163 - protein, 440 aa, Zea mays
  misc_feature (440)..(440): Xaa can be any naturally occurring amino acid
  unsure (1)..(440): unsure at all Xaa locations
AFEPHSPSSVLFSPSYSWLLATLCFRSAFSAPRFPLQLQSMASTDRSTPAEDEQQQKRPSLFSPYQMPRFRLAHRVVLAPMTRCRAPDAVPGPALAEYYAQRSTEGGLLISEGTIISPSGPGFPRVPGIYNQEQTDAWRKVVDAVHAKGAIFFCQLWHVGRASHQVYQPGAAAPISSTDKPISSRWRILMPDGSYGKYPTPRRLATSEIPEIVEQYRQAAINAIKAGFDGIEIHGAHGYLIDQFLKGGINDRTDEYGGSLSNRCRFLLEVTRAVVSAIGADRVAVRVSPAIDHLDAYDSNPLQLGMAVVERLNALQQEAGRLAYLHVTQPRYTAYGQTESGQHGSAEEESRLMRAVRGAYRGTFMCSGGYTRELGVEAIESGDADLVFYGRLFIANPDLVERFRRDAPLNKYVRKTFYTPDPVVGYTDYTFLGQPKARMX

SEQ ID NO: 11164 - protein, 206 aa, Zea mays
KNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAQKGDAGEGQ

SEQ ID NO: 11165 - protein, 243 aa, Zea mays; identical to SEQ ID NO: 11064

SEQ ID NO: 11166 - protein, 261 aa, Zea mays
  misc_feature (261)..(261): Xaa can be any naturally occurring amino acid
  unsure (1)..(261): unsure at all Xaa locations
RSLRCKQQSSTLSTRPSSSQEPTRTSAIRPAMAAARRLSLPLVLLVVLAVAGRAAAQDYDFFYLVLQWPGAYCDTKQSCCYPKSGKPAADFGIHGLWPNRDDGTYPQNCSPDNAFNPSKVSDLMSSLRAKWPTLACPSNDGLRFWGHEWEKHGTCAADVFDEHGYFQAALRLRDQLGVLGALTSAGVKPDGGYYTLSQIKGAIRQGTGFEPYVECNRDEAGNSQLYQLYFCVDAAGDSFVDCPVLPSGRPCGNRIEFPAFX

SEQ ID NO: 11167 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11168 - protein, 162 aa, Zea mays
  misc_feature (162)..(162): Xaa can be any naturally occurring amino acid
  unsure (1)..(162): unsure at all Xaa locations
MTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTVX

SEQ ID NO: 11169 - protein, 279 aa, Zea mays
  misc_feature (279)..(279): Xaa can be any naturally occurring amino acid
  unsure (1)..(279): unsure at all Xaa locations
MTMATKAACVLAVWVLVASGLSDLGSARAPLGSKPQREFDYFALSLQWPGTICASTRHCCATNGCCRSEPLQTFTIHGLWPDYDDGTWPSCCRRTQFEMDKILPLKEVLDKYWPSLYCSKSGTCFSGKGLFWAHEWEKHGTCSAPVVQDELQYFTLALDLYFKYNVTEMLSSGWIQVSNGKEYALSDVIDTIKHAFGGSPQIVCKRGSIEELRLCFDKELKPRDCLTTSLANGSVSKSKHCPRYITLPTYDPLVLANSTVEIMTQFDEFEVPAALYTAX

SEQ ID NO: 11170 - protein, 542 aa, Zea mays
  misc_feature (542)..(542): Xaa can be any naturally occurring amino acid
  unsure (1)..(542): unsure at all Xaa locations
MARGGDGLQVLSALDAAKTQWYHFTAIIVAGMGFFTDAYDLFCISLVTKLLGRIYYTDTSKDNPGSLPPNVAAAVNGVAFCGTLAGQLFFGWLGDKLGRKSVYGMTLMLMVICSVASGLSFGHTPTGVMATLCFFRFWLGFGIGGDYPLSATIMSEYANKKTRGAFIAAVFAMQGFGILAGGIVTLVISAAFRAGYPAPAYRDDHFNSTVPQADYVWRIILILGAAPAMLTYYWRMKMPETARYTALVAKNAKQAAADMSRVLQTEIVDEQEKLDEMVTAESNTFGLFSREFARRHGLHLVGTSTTWFLLDIAFYSQNLFQKDIFTSINWIPKANTMSALEEVFRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKADAGYPAGIGVRNSLFVLAASNLLGFILTFLVPESKGKSLEEMSGEADDAEDDAVGTRAVRPSGTQMVX

SEQ ID NO: 11171 - protein, 747 aa, Zea mays
  misc_feature (747)..(747): Xaa can be any naturally occurring amino acid
  unsure (1)..(747): unsure at all Xaa locations
GNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSERX

SEQ ID NO: 11172 - protein, 157 aa, Zea mays
MAAAATATPAVAPEAGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 11173 - protein, 349 aa, Zea mays
  misc_feature (16)..(17): Xaa can be any naturally occurring amino acid
  misc_feature (110)..(110): Xaa can be any naturally occurring amino acid
  misc_feature (137)..(137): Xaa can be any naturally occurring amino acid
  misc_feature (139)..(139): Xaa can be any naturally occurring amino acid
  misc_feature (157)..(157): Xaa can be any naturally occurring amino acid
  misc_feature (243)..(243): Xaa can be any naturally occurring amino acid
  misc_feature (258)..(258): Xaa can be any naturally occurring amino acid
  misc_feature (265)..(265): Xaa can be any naturally occurring amino acid
  unsure (1)..(349): unsure at all Xaa locations
AASSVRTWRDGSSSSXXAPPPGAAPRRCHRRGGFASGADDGGCCAAAGAAHAHQGRRVARHPRRRRLGPPWTVQPDLGCPADGRGGAEAGHRLRHLHRRQHLRRRHRQHXRPPLQGIVLQYLHCQQPSEALVPGPWXPXLHGKRARAARPCHSQSGXPVHRHCQVLHCQLRGCGFFPRRHNAVHCPLLEQHQVRLERRRSSRHLHRESPQGLEVCTDSVQGSLEDRRGSPPHQQRLRAWEQHXARGVASPGPQDTRGXHVLEWPXPLPAARQQQRQSSSATNQRRRVQGMGWQVQAHPRQGGVPLRRPGVHVDAPEQDGGPPRVLRRRWQRPALLDHACPKIKDDDDDD

SEQ ID NO: 11174 - protein, 314 aa, Zea mays
  misc_feature (314)..(314): Xaa can be any naturally occurring amino acid
  unsure (1)..(314): unsure at all Xaa locations
QEATSGSRRGSTRANPAASSPRTPSHPSRSTRRAGPPDMAPAAPYGGAESQRQADLLKQEGNAFFRKERLSAAIDAYTGAITLCPNVAVYWTNRALCYRKRNEWTRVEEDCRTAIQLDSQSVKAHYMLGLSLVNSQRLSEGIKSLEKSLELGRGAHPASYMVEEIWQELSKAKYIEWESLSRDRTCQLQKLKVACKEALTSYNSLDNPAAGAPVEQLNELEEVFKKAAKTDTPAEVPDHLCCKITLDIFRDPVITPSGITYERAVLLDHLQTVGRFDPVTREALEPHQLVPNLAIKEAVHAFLSEHGWAYKIRX

SEQ ID NO: 11175 - protein, 587 aa, Zea mays
  misc_feature (587)..(587): Xaa can be any naturally occurring amino acid
  unsure (1)..(587): unsure at all Xaa locations
MEAGGGASELGLLGAGSGRLLKHGRGDAAGGEDHGWVVVVGGGGRAKQARTASVGTGDAAATAAVPFLLGSCGGPGHGGERMLSFSSAAAAAPDDGGAMPPLYYGTPASCSGLMSSARVRGPFTPPQWIELEHQALIYKYLSANSPVPHSLLVPIRRSGSLASSPYPPPYFGTSTFGWGSFQLGYSGNADLEPGRCRRTDGKKWRCSRDAVADQKYCERHMNRGRHRSRKHVEDQPGHAAKAMSAVAVAAAAAAATQHAAALAGAGATAAAGLAVNRHRQPGKSYATGATDPCSLQYSRELANKLSNESENMQDSDNVSMLTSMNTGNTAGSVFPFSKQNTALFEVSSSRPEFGLVPSDSLTSSPHSSLKSVKNLLSSRSLSEHQSSASLQHFVDWPRTPPAQGGLSWPEAEDMPRAQRSQLSVSAPMASSELSSASTSPIHDHEKLILSPLKLGREYTPSGVVSAAANRYEVSQLEATWATMFRDSSTGGPLGEVLAKNNSNAEARGCPSAAPPLTDYYCWDSGHGMQSSPVGVLQRTTAFGSVSSSTGSSPRVESHGACCDGTSNLMDDDLGSVVVSHPSIRLLX

SEQ ID NO: 11176 - protein, 227 aa, Zea mays
  misc_feature (227)..(227): Xaa can be any naturally occurring amino acid
  unsure (1)..(227): unsure at all Xaa locations
PQQSSSLPPVSFSMTENLHSRKMVQPKKFRGVRQRHWGSWVSEIRHPLLKRRVWLGTFETAEEAARAYDEAAVLMSGRNAKTNFPIQRSSTGEPTPAAGRDARSNFSSGSSTTNLSQILSAKLRKCCKAPSPSLTCLRLDPEKSHIGVWQKRAGARADSNWVMTVELNKDAASTDAASQSTSATTAPPATPMDEEERIALQMIEELLSSSSPASPSNGDDQGRFIIX

SEQ ID NO: 11177 - protein, 360 aa, Zea mays
  misc_feature (360)..(360): Xaa can be any naturally occurring amino acid
  unsure (1)..(360): unsure at all Xaa locations
KMPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACEX

SEQ ID NO: 11178 - protein, 754 aa, Zea mays
  misc_feature (754)..(754): Xaa can be any naturally occurring amino acid
  unsure (1)..(754): unsure at all Xaa locations
MDSSGEELLKKIRELEVGQAQLKQEMSKLIPGAGERRRSQSVSPRRGVPVPPPPPAKAKAGAPGRRLSGGFEGGQRAWARGSASFPHSSPLQREGRATGAGDASTSARLPERQYSRVLQSMGQSVHILDLDGRIIYWNQSAENLFGYPASEALGQDALMLLVDSHDHNAVNNIFQRISMGESWTGKFPVKNKQGHRFSVVATNTPFYDEDGSLMGFICVSSDSRQLEQIFCKPPTSARSQSESSMTSCDGSCSNTSHRINSLNRSSFDSNLPLQSTLASKITNLATKVTNKVRSRVRTDENGDGGSGESHCLDRGAKEEPTSSGTSTPRGDAPHGPFATEENSPGKSTNPNSDESEGKVGLHKILGSKAEALLNKKGISWPWKGRENEGPDERNHVILPWLHGGQENGVNHQKVSDSSISPDAQGAEHNQPSKNEASGSWSSFNNNSTGSASSTGSTNSSALYKVDHEADCLDYEILWEDLVIGEQIGQGSCGTVYHALWYGSDVAVKVFSKQEYSEEVILTFRQEVSLMKKLRHPNILLFMGAVMSPQRLCIVSEFLPRGSLFRLLQRSATKLDVRRRVHMALDIVRGMNYLHHSSPPIIHRDLKSSNLLVDKNWIVKVADFGLSRLKRETFLTTKTGKGTPQWMAPEVLRNEPSDEKSDVYSYGVILWELVTQKIPWENLNSMQVIGAVGFMNQRLDIPSEVDPQWKSIILSCWESDPQQRPSFQELLERLRELQRHYAIQHRNTKNSIEEX

SEQ ID NO: 11179 - protein, 280 aa, Zea mays
  misc_feature (280)..(280): Xaa can be any naturally occurring amino acid
  unsure (1)..(280): unsure at all Xaa locations
PDHTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 11180 - protein, 145 aa, Zea mays
  misc_feature (145)..(145): Xaa can be any naturally occurring amino acid
  unsure (1)..(145): unsure at all Xaa locations
FTSLTPAARSLCPAIMAARSSSQQLVAAAAAAVLAAALLLLAAGAGTASAAVSCGEVTSSVAPCLGYAMGSAASPSAACCSGVRSLNSRASSTADRQATCNCLKSMTGRLGGGVSMANAANIPGKCGVSVGVPISPTVDCTKINX

SEQ ID NO: 11181 - protein, 622 aa, Zea mays
  misc_feature (622)..(622): Xaa can be any naturally occurring amino acid
  unsure (1)..(622): unsure at all Xaa locations
MSPNLDSAIKSQVPALLLRRLFGASRRDEAKQLQRTPAPVGRRRVFVQTETGCVLGMDLDRGDNAHTVKRRLQLAFNMPTGGTSLTFGDRVLENDLSFLRPDSPLLLTRNSINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAAHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLELMCMEARKRVAEWEPFSATAEHGEDTDFQFSVDMLGEYSDVVRSPRFNGSGSKVSSFRSPLSKLVESVDEGSDGHEDQNESDRVLYAGWNTSSVPSKAMGHSGNASKSAMNRSADEQLPSSMCFVRLSDMSADEWDVFLEKFQELLKETLHESARAAAGQRMKQRLGTSCKFX

SEQ ID NO: 11182 - protein, 247 aa, Zea mays
  misc_feature (247)..(247): Xaa can be any naturally occurring amino acid
  unsure (1)..(247): unsure at all Xaa locations
MNIYIVGLNQLFDIEIDKVNKPTLPLASGEYTLATGVAIVSVFAAMSFGLGWAVGSQPLFWALFISFVLGTAYSINLPYLRWKRFAVVAALCILAVRAVIVQLAFFLHIQTFVFRRPAVFSRPLLFATGFMTFFSVVIALFKDIPDIEGDRIFGIRSFSVRLGQKKVFWICVGLLEMAYSVAILMGATSSCLWSKTATIAGHSILAAILWSCARSVDLTSKAAITSFYMFIWKLFYAEYLLIPLVRX

SEQ ID NO: 11183 - protein, 183 aa, Zea mays
FWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACE

SEQ ID NO: 11184 - protein, 751 aa, Zea mays
  misc_feature (751)..(751): Xaa can be any naturally occurring amino acid
  unsure (1)..(751): unsure at all Xaa locations
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVACFQLHACCSYDLKSVIVIX

SEQ ID NO: 11185 - protein, 200 aa, Zea mays
  misc_feature (200)..(200): Xaa can be any naturally occurring amino acid
  unsure (1)..(200): unsure at all Xaa locations
MAATAMDHDGGDDVVTPGELLGNSLTLAAGRGAYADGRSVRASVTGRRRIVPPAPASDDQRSTVEVVGHKAHGAVPQPGSVVIARVTKVMARMASADIMCVDSKAIREKFTGMIRQQDVRATEIDKVDMYQSYRPGDIVKAMVLSLGDARAYYLSTAKNELGVVSAQSIAGGTLVPISWTEMQCDLTGQIEQRKVAKVEX

SEQ ID NO: 11186 - protein, 211 aa, Zea mays
  misc_feature (211)..(211): Xaa can be any naturally occurring amino acid
  unsure (1)..(211): unsure at all Xaa locations
QLPPNPSHQLPMAATAMDHDGGDDVVTPGELLGNSLTLAAGRGAYADGRSVRASVTGRRRIVPPAPASDDQRSTVEVVGHKAHGAVPQPGSVVIARVTKVMARMASADIMCVDSKAIREKFTGMIRQQDVRATEIDKVDMYQSYRPGDIVKAMVLSLGDARAYYLSTAKNELGVVSAQSIAGGTLVPISWTEMQCDLTGQIEQRKVAKVEX

SEQ ID NO: 11187 - protein, 83 aa, Zea mays
VPQRIVASSEVERSYIMIKPDGVQRGLVGEIISRFEKKGFLLKGLKLFQCPKDLAQEHYKDLKDKPFFPKLIDYITSGPVVCM

SEQ ID NO: 11188 - protein, 582 aa, Zea mays
  misc_feature (582)..(582): Xaa can be any naturally occurring amino acid
  unsure (1)..(582): unsure at all Xaa locations
MADEAKAKGNAAFSAGRFEEAARHFTDAIALAPDNHVLYSNRSAALASLHRYSDALADAQKTVDLKPDWAKGYSRLGAAHLGLGDAASAVAAYEKGLELDPSNEGLKAGLQDAKKAAAAPPRRGSSGPDAIGQMFQGPELWSKIASDPSTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAVETYQAGLKHDPNNQELLDGVKRCVEQINKANRGEISQDELQERQNKAMQDPEIQNILTDPIMRQVLIDFQENPSAAQEHLKNPGVMQKIQKLVSAGIVQMRX

SEQ ID NO: 11189 - protein, 245 aa, Zea mays
  misc_feature (245)..(245): Xaa can be any naturally occurring amino acid
  unsure (1)..(245): unsure at all Xaa locations
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSSVEISQYLPLLLKLVVLAYAALCLGELLHRWSSGGSCSLSPWCAX

SEQ ID NO: 11190 - protein, 279 aa, Zea mays
  misc_feature (279)..(279): Xaa can be any naturally occurring amino acid
  unsure (1)..(279): unsure at all Xaa locations
INWKHPAHIISRSERQRATAPARRPSIHRHPLAQSKGTLAMSAASKKLFQAARSLVLSASHRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 11191 - protein, 265 aa, Zea mays
  misc_feature (265)..(265): Xaa can be any naturally occurring amino acid
  unsure (1)..(265): unsure at all Xaa locations
RQRATAPARRPSIHRHPLAQSKGTLAMSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVNX

SEQ ID NO: 11192 - protein, 191 aa, Zea mays; identical to SEQ ID NO: 10771
  misc_feature (191)..(191): Xaa can be any naturally occurring amino acid
  unsure (1)..(191): unsure at all Xaa locations

SEQ ID NO: 11193 - protein, 396 aa, Allium porrum
  misc_feature (396)..(396): Xaa can be any naturally occurring amino acid
  unsure (1)..(396): unsure at all Xaa locations
MLSMDSLLTKPVVIPLPSPVCSLPILRGSSAPGQYSCRNYNPIRIQRCLVNYEHVKPRFTTCSRSQKLGHVKATSEHSLESGSEGYTPRSIWEAVLASLNVLYKFSRPHTIIGTAMGIMSVSLLVVESLSDISPLFFVGLLEAVVAALFMNVYIVGLNQLFDIEIDKVNKPDLPLASGEYSPRAGTAIVIASAIMSFGIGWLVGSWPLFWALFISFVLGTAYSINLPFLRWKRSAVVAAICILAVRAVIVQLAFFLHIQSFVFKRPASFTRPLIFATAFMSFFSVVIALFKDIPDIDGDKIFGIHSFSVRLGQERVFWICIYLLEMAYTVVMVVGATSSCLWSKCLTVIGHAILGSLLWNRARSHGPMTKTTITSFYMFVWKLFYAEYLLIPFVRX

SEQ ID NO: 11194 - protein, 400 aa, Zea mays
  misc_feature (400)..(400): Xaa can be any naturally occurring amino acid
  unsure (1)..(400): unsure at all Xaa locations
MDASKLRELRDFVEACKKNPSLLADPNLSFFRDYLQSLGAKIPAAAPSFESPKRSSMDDIDDDGDDDDDLDMRDPTPERDELDEEIVESDLELEGEIVQSDHDDPPQKMGNPSVEVTEENRDASQEAKGKAMEAISEGKLEDAIEHLTNAIVLNPLSAIMYGTRASVFIKMKKPAAAIRDANAALEINPDSAKGYKTRGMAYAMLGKWEEAAHDLHTASNMDYDEEINAVLKKVEPNAHKIVEHRRKYERLRKEREEKRAQRDRLRQRAEAQAAYDKAKRKEQSSSRSSGGASPRGFPGGMPGGGFPRGMPGGGFPGGGMPGGFPGGGMPGGFPGGVPGNVDMSKILNDPDLMAAFSDPEVMAALQDVMNNPANFAKHQANPKVGPIIAKMMAKFNGSQX

SEQ ID NO: 11195 - protein, 149 aa, Zea mays; identical to SEQ ID NO: 5266

SEQ ID NO: 11196 - protein, 242 aa, Triticum aestivum
  misc_feature (242)..(242): Xaa can be any naturally occurring amino acid
  unsure (1)..(242): unsure at all Xaa locations
TPPPRDMAGTGDDAGMDEVQRRLMFDDECILVDEQDNVVGHESKYTCHLMEKIESENLLHRAFSVFLFNSKHELLLQQRSATKVTFPLVWTNTCCSHPLYRESELIQENFLGVRNAAQRKLLDELGIPAEDVPVDQFTPLGRMLYKAPSDGKWGEHELDYLLFIVREVKLVPNPDEVADVKYVSREQLRELIQQADAGEGGVKLSPWFRLVVDNFLMGWWEHLEKGTLAEAVDMETIHKLKX

SEQ ID NO: 11197 - protein, 367 aa, Zea mays; identical to SEQ ID NO: 10819
  misc_feature (367)..(367): Xaa can be any naturally occurring amino acid
  unsure (1)..(367): unsure at all Xaa locations

SEQ ID NO: 11198 - protein, 201 aa, Zea mays
  misc_feature (201)..(201): Xaa can be any naturally occurring amino acid
  unsure (1)..(201): unsure at all Xaa locations
LEQTSKAFRPGGLPVLSPAPPRMAGATTPASGALVRLCLPSLLLFLYRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDELX

SEQ ID NO: 11199 - protein, 355 aa, Zea mays
  misc_feature (355)..(355): Xaa can be any naturally occurring amino acid
  unsure (1)..(355): unsure at all Xaa locations
AAASFVSRGEEEMAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAATNNKVFLMNLSAPFICEFFCDAQEKVFPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFNX

SEQ ID NO: 11200 - protein, 235 aa, Zea mays
  misc_feature (235)..(235): Xaa can be any naturally occurring amino acid
  unsure (1)..(235): unsure at all Xaa locations
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSQLPAAYPQQFLPFNQLAALNSAAYLQQQQLLPFSQLAGVSPATFLIQPQLLPFYQHAAPNAGTLLQLQQLLPFNQLALTNPAAFYQQPIIGGALFX

SEQ ID NO: 11201 - protein, 305 aa, Zea mays
  misc_feature (305)..(305): Xaa can be any naturally occurring amino acid
  unsure (1)..(305): unsure at all Xaa locations
LQLSDLQESAAEAPAMAAPMVDAEYLRQVDRARRHLRALISNKGCAPIMLRLAWHDAGTYDLKTKTGGANGSIRYEEEYTHGSNAGLKIAIDLLEPIKAKNPKITYADLYQLAGVVAVEVTGGPTVEFIPGRRDSSVCPREGRLPDAKKGAPHLRDIFYRMGLSDKDIVALSGGHTLGRAHPERSGFDGAWTKEPLKFDNSYFLELLNEESEGLLKLPTDKALLSDPEFRRYVELYAKDEDAFFKDYAESHKKLSELGFTPRSTAPSKSDLPTAAVLAQSAFGVAVAAAVVIAGYLYEASKKAKX

SEQ ID NO: 11202 - protein, 262 aa, Zea mays
  misc_feature (262)..(262): Xaa can be any naturally occurring amino acid
  unsure (1)..(262): unsure at all Xaa locations
LFLTGLLEAVVAALFMNIYIVGLNQLFDIEIDKVNKPTLPLASGEYTLATGVAIVSVFAAMSFGLGWAVGSQPLFWALFISFVLGTAYSINLPYLRWKRFAVVAALCILAVRAVIVQLAFFLHIQTFVFRRPAVFSRPLLFATGFMTFFSVVIALFKDIPDIEGDRIFGIRSFSVRLGQKKVFWICVGLLEMAYSVAILMGATSSCLWSKTATIAGHSILAAILWSCARSVDLTSKAAITSFYMFIWKLFYAEYLLIPLVRX

SEQ ID NO: 11203 - protein, 205 aa, Zea mays
  misc_feature (205)..(205): Xaa can be any naturally occurring amino acid
  unsure (1)..(205): unsure at all Xaa locations
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGGMGGMGDMAGMGGLGGMGGMGGLGGMGGMGMDDFEDESDDEEVSKPQAADKAVEAEETESAETKIEAAQSSX

SEQ ID NO: 11204 - protein, 215 aa, Zea mays
  misc_feature (215)..(215): Xaa can be any naturally occurring amino acid
  unsure (1)..(215): unsure at all Xaa locations
MAKSSSYGLGLACFFAIAAAVAGGTQFMVGGANGWSVPTAGAEPFNTWAERTRFQIGDSLVFVYPKDQDSVLLVEPADYNACDTSSYVRKFDDGDTVVTLDRSGPLFFISGVEANCRANEKLIVMVLAARSNGNGTGGGARAPSTAPQPASPAASPPPASSTPPPPSSPAPKGASPPPASAPTTSPGTTPPPAPSASSPAPAGSETRTRRRGTRX

SEQ ID NO: 11205 - protein, 540 aa, Zea mays
  misc_feature (540)..(540): Xaa can be any naturally occurring amino acid
  unsure (1)..(540): unsure at all Xaa locations
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGHTPTGVMATLCFFRFWLGFGIGGDYPLSATIMSEYANKRTRGAFIAAVFAMQGFGILAGGIVTLVISAAFRAAYPSPAYRDDHFTSTVPQADFVWRVILMLGAAPALLTYYWRMKMPETARYTALVAKNAKQAAADMSKVLQTEIVDEQEKLDAAEGANSFGLFSREFARRHGLHLVGTATTWFLLDIAFYSQNLFQKDIFTSINWIPKANTMSALEEVYRISRAQTLIALCGTVPGYWFTVALIDVVGRFAIQLLGFFMMTVFMLGLAIPYHHWTTPGNHIGFVVMYAFTFFFANFGPNSTTFIVPAEIFPARLRSTCHGISAASGKAGAIIGAFGFLYAAQNQDKSKTDAGYPAGIGVRNSLFVLAASNMLGFVLTFLVPESKGKSLEEMSGEAEDSEEEPVGARAVRPSETQMVX

SEQ ID NO: 11206 - protein, 223 aa, Zea mays; identical to SEQ ID NO: 10692
  misc_feature (223)..(223): Xaa can be any naturally occurring amino acid
  unsure (1)..(223): unsure at all Xaa locations

SEQ ID NO: 11207 - protein, 788 aa, Zea mays
  misc_feature (788)..(788): Xaa can be any naturally occurring amino acid
  unsure (1)..(788): unsure at all Xaa locations
MAPALSGTLGASSVAALRPCAGRRAPSAASSVAPRGSGVVRCSRGLRWDAHRSRGRLLRVRCDAAVAEKPAEEEAAGEKFEYQAEVSRLMDLIVHSLYSHKEVFLRELVSNASDALDKLRFLGVTDSSLLADGGELEIRIKPDLDAGTITITDTGVGMTKDELKDCLGTIAQSGTSKFLKALKENKDLGADNGLIGQFGVGFYSAFLVAEKVVVSTKSPKSDKQYVWEAVADSSSYVIKEETDPEKMLTRGTQITLFLRPDDKYEFADPSRIQGLVKNYSQFVSFPIYTWQEKSRTVEVEEDEEPKEVEEATKGEKKKKTITEKYWDWELANETKPIWMRNPKEIENTEYNEFYKKTFNEFLDPLAHTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKTFDMIEEIAEKEDKEDYKKFWESFGKFVKLGCIEDTGNHKRLAPLLRFHSSKNEGDLISLDQYVESMPESQKAIYYIATDSLQSAKTAPFLEKLVQKDIEVLYLIEPIDEVAIQNLQTYKEKKFVDISKEDLELGDEEEETKETKQEFTLLCDWVKQQLGDKVAKVQISKRLSSSPCVLVSGKFGWSANMERLMKAQTLGDTSSLEFMRGRRIFEINPDHPIIKDLSAACKNEPESTEARRAVELLYEAALISSGYTPESPAELGGKIYEMMAIALGGRWGRSDMEEAEASTGEASAEADSSEVTVAEVIEPSEVRPESDPWRDQX

SEQ ID NO: 11208 - protein, 400 aa, Zea mays; identical to SEQ ID NO: 10542
  misc_feature (400)..(400): Xaa can be any naturally occurring amino acid
  unsure (1)..(400): unsure at all Xaa locations

SEQ ID NO: 11209 - protein, 279 aa, Zea mays; identical to SEQ ID NO: 11169
  misc_feature (279)..(279): Xaa can be any naturally occurring amino acid
  unsure (1)..(279): unsure at all Xaa locations

SEQ ID NO: 11210 - protein, 241 aa, Zea mays
  misc_feature (241)..(241): Xaa can be any naturally occurring amino acid
  unsure (1)..(241): unsure at all Xaa locations
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVESKDTTQRDEESERGLITCITHGAMSEDDYFNCIERGVMASSRISDFMRKTLQKEASRDAX

SEQ ID NO: 11211 - protein, 487 aa, Zea mays
  misc_feature (487)..(487): Xaa can be any naturally occurring amino acid
  unsure (1)..(487): unsure at all Xaa locations
AMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11212 - protein, 177 aa, Zea mays
  misc_feature (177)..(177): Xaa can be any naturally occurring amino acid
  unsure (1)..(177): unsure at all Xaa locations
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11213 - protein, 402 aa, Zea mays
  misc_feature (402)..(402): Xaa can be any naturally occurring amino acid
  unsure (1)..(402): unsure at all Xaa locations
MADAGEGRRVCGMPEKAQLHVAMLALQFGYAGFHVVSRLALNMGISKLVFPVYRNIIALCLLVPFAYFLEKKDRPQLTLNFVIQFFLLALCGITANQGFYLLGLDNTSPTFASAIQNSVPAITFAMAAALRIEKVRLDRRDGVAKVAGTLACVAGASVITLYKGPTIFGPSGGGGGGDKLQLQQVAVAVAAGEKNWTLGCVYLIGHCLSWSGWLVLQAPVLKKYPARLSVTSYTCFFGVIQFLVIAAFMERDADAWKFHSGSELFTILYAGFIASGVAFAVQIWCIDRGGPVFVAVYQPVQTLVVAIMASLTLGEKFYLGGIIGAVLIIAGLYLVLWGKSEERARIARDAAAALVVSGAGDREGLLAAGGGGGGGIRSKAAASAAVTQPLLLPSSTSTDNVX

SEQ ID NO: 11214 - protein, 205 aa, Zea mays
  misc_feature (205)..(205): Xaa can be any naturally occurring amino acid
  unsure (1)..(205): unsure at all Xaa locations
VFPKSSKPQSLNPRRRPHDAHLRSRGGSMSRHPITKWAQRSDRVFLTIELPDAKDVKLNLKSEGHFNFSAKGSDDLPYEFDIELFDAVNVEESKAAVAPRTICYLIKKAKSGWWPRLLKQEGKPPVFLKVDWDKWQDEDDEDAGFNDFGGMDFSKLDIGGADDDDIGDDEDDVVESANKDEEGGKTEESKEEEAAPAAAEEVKPX

SEQ ID NO: 11215 - protein, 390 aa, Glycine max
  misc_feature (390)..(390): Xaa can be any naturally occurring amino acid
  unsure (1)..(390): unsure at all Xaa locations
MADLGSASSKRMWCSVPERMQLHLAMLALQFGYAGFHVVSRAALNMGVSKLVFPVYRNIIALLLLLPFAYFLEKKDRPAMTLNFVCQFFLLALVGITANQGFYLLGLENTSPTFASAIQNSVPAITFLMAAILRIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGIIGAVLIVAGLYLVLWGKSEERKFAREQLAIASTEHSIIRPASHAKASLAQPLLSSSTENVX

SEQ ID NO: 11216 - protein, 307 aa, Glycine max
  misc_feature (307)..(307): Xaa can be any naturally occurring amino acid
  unsure (1)..(307): unsure at all Xaa locations
MKSSRRLLRIGLVSAWYSSNIGVLLLNKYLLSNYGFKYPIFLTMCHMTACSLFSYVAIAWLKMVPMQTIRSRLQFLKIAALSLIFCFSVVFGNVSLRYLPVSFNQAVGATTPFFTAVFAYVMTFKREAWLTYLTLVPVVTGVVIASGGEPSFHLFGFIVCIAATAARALKSVLQGILLSSEGEKLNSMNLLLYMAPIAVVFLLPATLIMEENVVGITLALARDDVKIIWYLLFNSALAYFVNLTNFLVTKHTSALTLQVLGNAKGAVAVVVSILIFRNPVSVTGMMGYSLTVLGVVLYSQAKKRSKX

SEQ ID NO: 11217 - protein, 353 aa, Glycine max
  misc_feature (353)..(353): Xaa can be any naturally occurring amino acid
  unsure (1)..(353): unsure at all Xaa locations
MAPSFDFASSLLCTEDSTVFDESHNNGGTMMTAMGVYEDTRSPRRRHFDEEPDELPLLSDESLVMMVEKECQHWSGLRYLNKFQTGDLDFGARMEAIDWIHKVRSHFGFGPLCGYLSINYLDRFLFAYELPKGRVWTMQLLAVACLSLAAKLDETEVPLSLDLQVGESKFLFEAKTIQRMELLVLSTLKWRMQAITPFTFLDYFLCKINDDQSPLRSSIMRSIQLISSTARGIDFLEFKPSEIAAAVAMYVMGETQTVDTGKAISVLIQHVEKERLLKCVQMIQELSCNSGSAKDSSASVTCLPQSPIGVLDALCFNYKSDDTNASSCVNSSHNSPVAKRRKLNKTCGAEQLX

SEQ ID NO: 11218 - protein, 270 aa, Glycine max
NRIVGYTGISFSSPTLSSAISNLVPAFTFLLAIIFRMEKVIVRNTTCQAKVLGTIVSITGAFVVTFYKGPPIIIVHTPSLSLHQPINTLNSVDRSWAIGGLLLTAEYILVPLWYIVQVQIMKVYPNELTVIFFYNLCVSIMAAIVAIFTETNAGAWKIGLDTALASIVCSGIFGSFVNNAVHTWVLRIKGPVYVAMFKPLSIAIAVALGVMFLGDTLHLGSLVGATVISIGFYTVMWGKATEENVDEDVPGQQSPPTTENVPLLQSYKTD

SEQ ID NO: 11219 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11220 - protein, 416 aa, Glycine max
  misc_feature (416)..(416): Xaa can be any naturally occurring amino acid
  unsure (1)..(416): unsure at all Xaa locations
LICLLLHASCSRLLFICTRTISHAFHSSHTTLSPKFKLRLRGEKERIHMGAGLVAFLLMVLVQLVYAVMNITSKLAIESGMSPLVLVAYRQLFATVSIAPFAYWLEWNTLPRITQRLMIQILFSSLTGVTGNQMLYFVGLKYSSATIACALTNLLPAFTFILAVLFRQENLGIKKRAGLAKVFGTILCVSGALLLSFYHGKTIGLGQSSIHWRYAEKMEGTSSSGKGNMFLGPLVVILSTLVWAAWFIIQKDISKTFPAPYTSTGLMCFMASFQCVIIAVCVDHRASAWSLHNAMRLSSALYAGIFCTGLAYCLMSWTIERKGPLYVSVFTPLQLVLTAILSWALLREKLYVGTAVGSLLIVLGLYSVLWGKSEEVNKGDGIEEDAVKEAVKDSKNDMELQSYVPSNGNNGRVIAX

SEQ ID NO: 11221 - protein, 159 aa, Zea mays
SMYSESRGEARDFARVRNTCFEQARQAYLVGNKALAKELSMKGQAYNVQMKAAHEKAREAIYRQRNPVSSQRGGGDHLIDLHGLHVNEAIHILKGELTALKSAARAAGERMQVMVCVGTGHHTKGSRTARLPIAVEQFLLDEGLQYTQPQAGLLRVMVY

SEQ ID NO: 11222 - protein, 703 aa, Zea mays; identical to SEQ ID NO: 10805
  misc_feature (703)..(703): Xaa can be any naturally occurring amino acid
  unsure (1)..(703): unsure at all Xaa locations

SEQ ID NO: 11223 - protein, 374 aa, Glycine max
  misc_feature (374)..(374): Xaa can be any naturally occurring amino acid
  unsure (1)..(374): unsure at all Xaa locations
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRYFLYQLLRGLKYVHSANVLHRDLKPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPATIYVX

SEQ ID NO: 11224 - protein, 346 aa, Glycine max
  misc_feature (346)..(346): Xaa can be any naturally occurring amino acid
  unsure (1)..(346): unsure at all Xaa locations
MAVSDGVVKKIVLSYTYVAIWIFLSFTVIVYNKYILDRKMYNWPYPISLTMIHMAFCSSLAYILVRVLKLVEPVSMSRDLYLKSVVPIGALYPLSLWFSNSAYIYLSVSFIQMLKALMPVAVYSIGVIFKKEAFKNETMANMVSISLGVAVAAYGEAKFDAWGVTLQLMAVAFEATRLVLIQILLNSKGISLNPITSLYYIAPCCLVFLSVPWIIMEYPSLRDNSSFHLDFAIFGTNSACAFALNLAVFLLVGKTSALTMNVAGVVKDWLLIAFSWSVIKDTVTPINLIGYGLAFLGVAYYNHCKLQALKASEAQKKALQADEEAGRLLEQKDGEGTGRKNDNQNX

SEQ ID NO: 11225 - protein, 389 aa, Glycine max
  misc_feature (389)..(389): Xaa can be any naturally occurring amino acid
  unsure (1)..(389): unsure at all Xaa locations
MADSGSASSSRMWCSIPERVQLHAAMLALQFGYAGFHVVSRAALNMGISKLVFPVYRNIIAFLLLLPFAYFLEKKERPAITLNFLLQFFLLALVGITANQGFYLLGLDNTSPTFASAIQNSVPAITFLMAVILRIEQVRLNRKDGIAKVAGTIFCVAGATVITLYKGPTIYSPSPPLQSESSVVVEFGTLSSLGDAKGKNWTLGCLYLIGHCLSWSAWLVLQAPVLKKYPARLSVTSYTCFFGLIQFLVIALIVERDAQAWIFQSGGEVFTILYAGVVASGIAFAVQIWCIDRGGPVFVAVYQPVQTLVVAIMASLALGEEFYLGGIIGAVLIVVGLYFVLWGKSEERKFAKEHAAITSTPEHSGIRSSSHAKTLLTQPLLPSSTENVX

SEQ ID NO: 11226 - protein, 522 aa, Glycine max
  misc_feature (522)..(522): Xaa can be any naturally occurring amino acid
  unsure (1)..(522): unsure at all Xaa locations
YRATYFTAMLPRSRTLPSRIHQGIIEERHDVRPYVQVEVRPNNIQTETQAMNIQSNYSKCFDDDGRLKRTGTFWTATAHIITAVIGSGVLSLAWAVAQLGWVAGPVVMFLFAVVNLYTSNLLTQCYRTGDSVNGHRNYTYMEAVKSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKTFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSYX

SEQ ID NO: 11227 - protein, 340 aa, Glycine max
  misc_feature (340)..(340): Xaa can be any naturally occurring amino acid
  unsure (1)..(340): unsure at all Xaa locations
IWTPNTLIGLGLGQFLSLLITSTGFTSSQLAKKGINAPTSQSFLNYVFLSLVYGTILLYRRKALKAKWYYYIILGLVDVEANFLVVKAYQYTSLTSVMLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAEAALPFVGFAVAMFMFYSLVPVLLKINGSTMLNLSLLTSDMWAVLIRIFAYHEKVDWMYFVSFGAVTIGLIIYSGGDIDEDQHPPNAAIVDLGPAVKQDEEANSGNHSKGTAAGSSKTWVAX

SEQ ID NO: 11228 - protein, 383 aa, Glycine max
  misc_feature (383)..(383): Xaa can be any naturally occurring amino acid
  unsure (1)..(383): unsure at all Xaa locations
QLHFRSGTITPNLKNKTSSYYFPFGGAAMVEAQTWTTRRMSNPRLDTSTTDQVLDIPPTPPGELRNSFGSNPNNLSPTLLTALIISSWYLSNIGVLLLNKYLLSFYGYRFPIFLTMLHMLSCAAYSYASINFLELVPLQHIHSKKQFLKIFALSAIFCFSVVCGNTSLRYLPVSFNQAIGATTPFFTAIFAFLITCKKETGEVYLALLPVVFGIVVASNSEPLFHLFGFLVCVGSTAGRALKSVVQGILLTSEAEKLHSMNLLLYMAPLAAMILLPFTLYIEGNVLALTIEKAKGDPFIVFLLLGNATVAYLVNLTNFLVTKHTSALTLQVLGNAKAAVAAVVSVLIFRNPVTVMGMAGFGITIMGVVLYSEAKKRSKVTTHX

SEQ ID NO: 11229 - protein, 228 aa, Oryza sativa
  misc_feature (228)..(228): Xaa can be any naturally occurring amino acid
  unsure (1)..(228): unsure at all Xaa locations
MAEEHETRPPSAGRPPSSGRGRADDADEREEGEIADDDSGHAPPQANPAAPHPLEHAWTFWFDNPQGKSKQATWGSSIRPIHTFSTVEDFWSLYNNIHHPSKLVVGADFHCFKNKIEPKWEDPICANGGKWTFSCGRGKSDTMWLHTLLAMIGEQFDYGDEICGAVVSVRGKQERIAIWTKNAANEAAQISIGKQWKEFLDYKDSIGFIVHDDAKKMDKGLKNRYTVX

SEQ ID NO: 11230 - protein, 515 aa, Oryza sativa
  misc_feature (515)..(515): Xaa can be any naturally occurring amino acid
  unsure (1)..(515): unsure at all Xaa locations
PITTSTSRTQSVLPVRTWPPLAKLGIEMGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSSX

SEQ ID NO: 11231 - protein, 347 aa, Oryza sativa
  misc_feature (347)..(347): Xaa can be any naturally occurring amino acid
  unsure (1)..(347): unsure at all Xaa locations
AVQVSLAMARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEAX

SEQ ID NO: 11232 - protein, 413 aa, Triticum aestivum
  misc_feature (413)..(413): Xaa can be any naturally occurring amino acid
  unsure (1)..(413): unsure at all Xaa locations
PLPAPHPRAAAAMDSLRLRPSSLRSAPGAAAARRRDHILPSFCSIQRNGKGRVTLSIQASKGPTINHCKKFLDWKYSNHRISHQSINTSAKAGQSLQPETEAHDPASFWKPISSSLDAFYRFSRPHTIIGTALSIVSVSLLAVESLSDISPLFLTGLLEAVVAALFMNIYIVGLNQLFDIEIDKVNKPTLPLASGEYSPATGVAIVSVFAAMSFGLGWVVGSPPLFWALFISFVLGTAYSVNLPYFRWKRSAVVAALCILAVRAVIVQLAFFLHIQTFVFRRPAVFSKPLIFATAFMTFFSVVIALFKDIPDIEGDRIFGIQSFSVRLGQSKVFWTCVGLLEVAYGVAILMGVTSSSLWSKSLTVVGHAILASILWSSARSIDLTSKAAITSFYMLIWRLFYAEYLLIPLVRX

SEQ ID NO: 11233 - protein, 355 aa, Zea mays
  misc_feature (355)..(355): Xaa can be any naturally occurring amino acid
  unsure (1)..(355): unsure at all Xaa locations
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSREX

SEQ ID NO: 11234 - protein, 214 aa, Zea mays
FQAESKDHLQENWRIVDFFSHHPESLHMFTSLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCA

SEQ ID NO: 11235 - protein, 246 aa, Zea mays
  misc_feature (246)..(246): Xaa can be any naturally occurring amino acid
  unsure (1)..(246): unsure at all Xaa locations
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSCX

SEQ ID NO: 11236 - protein, 692 aa, Zea mays
  misc_feature (692)..(692): Xaa can be any naturally occurring amino acid
  unsure (1)..(692): unsure at all Xaa locations
MASSAFLPELGTQVVVPVAAVVGIAFAVLQWVLVSKVKLSPEPRRGDGSAGKSGAGAGASEYLIEEEEGLNEHNVVVKCAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNFGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIFNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEASSSNGFRGRMEDGWVVYFCRGRALDICHREVSVYPYGALHPFLFRLYCVAVLLNLSAVVSPSCWVX

SEQ ID NO: 11237 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11238 - protein, 303 aa, Zea mays
  misc_feature (303)..(303): Xaa can be any naturally occurring amino acid
  unsure (1)..(303): unsure at all Xaa locations
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEDPEKYQSHFSAYIKKGVEADEIEALYKKVHAAIRADPSIVKSTKQPPKEHKRYNPKKLTYEQRKASLIERLNQLNSSGGADDDDEDDEX

SEQ ID NO: 11239 - protein, 376 aa, Zea mays
  misc_feature (376)..(376): Xaa can be any naturally occurring amino acid
  unsure (1)..(376): unsure at all Xaa locations
SSPVQPDQSPSPPPQGAASRRSELESGPSSPHHKSGKGREVMGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILGQCRELKFLDLRGCWAVDDRFLRERHPGLRVLGPRVVDDCYENSYWEECSDYYSDEDEDYDDDVVSWGLFVDDDDYYYAVGSDDDEAIWDDAQGLENLEVRFYGGGGFGESFAGFDWPPSPX

SEQ ID NO: 11240 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11241 - protein, 275 aa, Zea mays; identical to SEQ ID NO: 10898
  misc_feature (275)..(275): Xaa can be any naturally occurring amino acid
  unsure (1)..(275): unsure at all Xaa locations

SEQ ID NO: 11242 - protein, 393 aa, Zea mays
  misc_feature (393)..(393): Xaa can be any naturally occurring amino acid
  unsure (1)..(393): unsure at all Xaa locations
MADAGEGRRVCGMPEKAQLHVAMLALQFGYAGFHVVSRLALNMGISKLVFPVYRNIIALCLLVPFAYFLEKKDRPQLTLNFVVQFFFLALCGITANQGFYLLGLDNTSPTFASAIQNSVPAITFAMAAALRIEKVRLDRRDGVAKVAGTLACVAGASVITLYKGPTIFGPSASGGLELAATSKAVAGDKNWTLGCVYLIGHCLSWSGWLVLQAPVLKKYPARLSVTSYTCFFGVIQFLIIAAFMERDADAWKFHSGSELFTILYAGFIASGVAFAVQIWCIDRGGPVFVAVYQPVQTLVVAIMASLTMGEKFYLGGIIGAVLIIAGLYLVLWGKSEERARFARDAATLVSGTGDREGLLPAGGGGIRSASKAAASAATQPLLLPSSTSTDNVX

SEQ ID NO: 11243 - protein, 507 aa, Zea mays
  misc_feature (507)..(507): Xaa can be any naturally occurring amino acid
  unsure (1)..(507): unsure at all Xaa locations
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKLX

SEQ ID NO: 11244 - protein, 431 aa, Zea mays
  misc_feature (431)..(431): Xaa can be any naturally occurring amino acid
  unsure (1)..(431): unsure at all Xaa locations
MRSTMKAQHANGRGSRSPFLTSYALTLAFITFVSVLYFKDFSSTLHRPFLHRPRRHAAPDKSQAGRRAAAERLPFAVGAAPAGCDVGRGEWVYDDAARPWYQEEECPYIQPQLTCQAHGRPDRAYQHWRWQPRGCSLPSFNATLMLEMLRGKRMLFVGDSLNRGQYVSLVCLLHRIIPESSKSMETVDSLTVFKAKDYNATIEFYWAPFLAESNSDDAVVHRIADRIVRGTSIEKHAKFWKGADILVFNTYLWWMTGQKMKILRNSFEDKSKDIIEMETEEAYEMVLNAVLKWVESNMNPRTSRTFFVTMSPTHTRSRDWGDDTDGNCYNQTAPIEDLSYWGPDTSKGLMRVIGEVFSASKSRIPVGVVNITQLSEYRKDAHTQIYKKQWNPLTPEQVADPKSYADCTHWCLPGLQDTWNELLYSKLFFPX

SEQ ID NO: 11245 - protein, 181 aa, Triticum aestivum
  misc_feature (181)..(181): Xaa can be any naturally occurring amino acid
  unsure (1)..(181): unsure at all Xaa locations
MVGSGMHAQRGDPLVVGRVIGDVVDPFVRRVALRVGYASRDVANGCELRPSAIADPPRVEVGGPDMRTFYTLVMVDPDAPSPSDPSLREYLHWLVTDIPATTGVSFGTEVVCYEGPRPVLGIHRLVFLLFQQLGRQTVYAPGWRQNFSTRDFAELYNLGLPVAAVYFNCQRETGTGGRRMX

SEQ ID NO: 11246 - protein, 185 aa, Triticum aestivum
  misc_feature (185)..(185): Xaa can be any naturally occurring amino acid
  unsure (1)..(185): unsure at all Xaa locations
VYTLALRLQNIMANDSLTRAQIVGDVLDPFVSSVPLTVMYDGRPVFNGMEFRSPAVSLKPSVEIGGDDFRVAYTLVMVDPDAPNPSNPTLREYLHWMVTDVPSSTNDSFGKEIVPYESPSPTMGIHRMVLVLYQQLGRGTVFAPQARQSFNSRSFARRFNLGKPVAAVYFNCQRPTGTGGRRFTX

SEQ ID NO: 11247 - protein, 176 aa, Oryza sativa
  misc_feature (176)..(176): Xaa can be any naturally occurring amino acid
  unsure (1)..(176): unsure at all Xaa locations
KRVAHSTPSPSISSRRLPPRESATPRAIKSKAAIEMRKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANAX

SEQ ID NO: 11248 - protein, 83 aa, Oryza sativa
MAARTVAVAAALAVLLIFAASSATVAMAGRPTPTTSLDEEAAQAAAQSEIGGGCKEGEGEEECLARRTLTAHTDYIYTQQHHN

SEQ ID NO: 11249 - protein, 211 aa, Oryza sativa
  misc_feature (211)..(211): Xaa can be any naturally occurring amino acid
  unsure (1)..(211): unsure at all Xaa locations
KKNPNPSTPNRHAGREERTTSHRARPNRRSCFPEEKNMSRHPSTKWAQRSDKVFLTIELPDARDVKLNLKPEGQFIFSAKGPADDTPYELDLELFDAVNVEESKAAVAARSICYLIKKAESKWWPRLLKKEGKPPVFLKVDWDKWQDEDDEDIGLGDFGDMDFSKLGMGGPDDDLEDDDEDDTADSANKDDEDIKAEGSGEQEAAGEAKPX

SEQ ID NO: 11250 - protein, 351 aa, Oryza sativa
  misc_feature (351)..(351): Xaa can be any naturally occurring amino acid
  unsure (1)..(351): unsure at all Xaa locations
GNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYAX

SEQ ID NO: 11251 - protein, 266 aa, Oryza sativa
  misc_feature (266)..(266): Xaa can be any naturally occurring amino acid
  unsure (1)..(266): unsure at all Xaa locations
MSPAEPTREESVYKAKLAEQAERYEEMVEYMERVARAAGGASGGEELTVEERNLLSVAYKNVIGARRASWRIISSIEQKEEGRGNDAHAATIRSYRGKIEAELARICDGILALLDSHLVPSAGAAESKVFYLKMKGDYHRYLAEFKSGDERKQAAESTMNAYKAAQDIALADLAPTHPIRLGLALNFSVFYYEILNSPDRACNLAKQAFDEAISELDSLGEESYKDSTLIMQLLRDNLTLWTSDANDDGGDEIKEAAAPKEPGDQX

SEQ ID NO: 11252 - protein, 405 aa, Oryza sativa; identical to SEQ ID NO: 10550
  misc_feature (405)..(405): Xaa can be any naturally occurring amino acid
  unsure (1)..(405): unsure at all Xaa locations

SEQ ID NO: 11253 - protein, 317 aa, Sorghum bicolor
  misc_feature (317)..(317): Xaa can be any naturally occurring amino acid
  unsure (1)..(317): unsure at all Xaa locations
MSFLFKSSNGGTTEKTMPLEEQQEKINELRKVLGDHSSPAIQDFLSDASLARFLRARNWNVQKASKMMKAAVKWRLAFKPENICWDDISEEAETGKIYRADYKDKHGRTVLVLRPGLENTTSATGQIKYLVYSLEKAIMNLTEDQEKMVWLTDFQSWTLGSTPLKVTRETVNVLQDCYPERLGLAILYNPPRIFESFWKIVKPFLDQETRKKVKFVYSNDKESQKIMAEVFDMEELDSAFGGKNPATFEYNSYAERMQEDDKKMGSLHSSTNSLLESAEKEANGADSDASSEASFYSGTDSPKHEDGEHSIAKKSGX

SEQ ID NO: 11254 - protein, 426 aa, Sorghum bicolor
  misc_feature (426)..(426): Xaa can be any naturally occurring amino acid
  unsure (1)..(426): unsure at all Xaa locations
KPPNPLPSPIHLDSLPSIAAAAAAAAKGGGAMGGAGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSPDDADDGAASANNNNGSVRCNGTPQPGIELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGGGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNAAAAAAAEGGLDPILAYTAGAEIEQLQWSATQPDWVAIAFANKLQILRVX

SEQ ID NO: 11255 - protein, 254 aa, Sorghum bicolor
  misc_feature (254)..(254): Xaa can be any naturally occurring amino acid
  unsure (1)..(254): unsure at all Xaa locations
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITEEGTEEGKEASKGDAEX

SEQ ID NO: 11256 - protein, 531 aa, Sorghum bicolor
  misc_feature (531)..(531): Xaa can be any naturally occurring amino acid
  unsure (1)..(531): unsure at all Xaa locations
LFSSPSGFWPSPSTQSRGVCSPNPFRPPRLLDAIPPAAMDPYKHRPSSGSNSSFWTTNSGAPVWNNNSALTVGQRGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDDEAVTVGGTCHSHATKDLYDSIAAGNYPEWKLYIQTIDLDHEDKFDFDPLDVTKTWPEDIIPLQPVGRMVLNKNIDNFFAENEQIAFCPAIIVPGIHYSDDKLLQTRIFSYADTQRHRLGPNYLMLPVNAPKCAHHNNHHEGFMNFMHRDEEVNYFPSRFDPTRHAEKVPIPSRVLTGCREKCIIEKENNFKQAGERFRSFDPARQDRFIQRWVDALSDPRVTHEHHTIWINYWSQCDASLGQKLASRLNLKPNMX

SEQ ID NO: 11257 - protein, 396 aa, Sorghum bicolor
  misc_feature (396)..(396): Xaa can be any naturally occurring amino acid
  unsure (1)..(396): unsure at all Xaa locations
AAAVSVARLGQRAAPMASVAELKEKHAAATASVNSLRERLRQRRETLLDTDVARYSKSQGRLPVSFNPTDLVCCRTLQGHSGKVYSLDWTPEKNWIVSASQDGRLIVWNALTSQKTHAIKLHCPWVMTCAFAPNGQSVACGGLDSACSIFNLNSQADRDGNMPVSRILTGHKGYVSSCQYVPDQETRLITSSGDQTCVLWDVTTGQRISIFGGEFPSGHTADVQSVSINSSNTNMFVSGSCDTTVRLWDIRIASRAVRTYHGHEGDVNSVKFFPDGHRFGTGSDDGTCRLFDMRTGHQLQVYSRVPDRNDDELPTVTSIAFSISGRLLFAGYSNGDCYVWDTLLAEVVLNLGNLQNSHDGRISCLGMSSDGSALCTGSWDKNLKIWAFSGHRKIVX

SEQ ID NO: 11258 - protein, 102 aa, Sorghum bicolor
MRTICDVCESAPAVLFCAADEAALCRSCDEKVHMCNKLASRHVRVGLADPNKLARCDICENSPAFFYCEIDGTSLCLSCDMTVHVGGKRTHGRYLLLRQRVE

SEQ ID NO: 11259 - protein, 166 aa, Zea mays; identical to SEQ ID NO: 9961
  misc_feature (166)..(166): Xaa can be any naturally occurring amino acid
  unsure (1)..(166): unsure at all Xaa locations

SEQ ID NO: 11260 - protein, 358 aa, Zea mays
  misc_feature (358)..(358): Xaa can be any naturally occurring amino acid
  unsure (1)..(358): unsure at all Xaa locations
MDKPVAPGIIKEELLEQQPPTQDGVGGGGDAPRPMEGLHEVGPPPFLTKTFDLVEDPATDAVLSWSRAGNSFIVWDPHVFADGLLPRLFKHSNFSSFVRQLNTYGFRKVDPDRWEFANEGFLRGQRHLLKMIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFWAELLVEDFGDKAGQPELEGRTEDVNDLAQQLGYLSSSSPKX

SEQ ID NO: 11261 - protein, 498 aa, Zea mays
  misc_feature (498)..(498): Xaa can be any naturally occurring amino acid
  unsure (1)..(498): unsure at all Xaa locations
VRRALGNARPAVGERRTRMECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMTFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSGX

SEQ ID NO: 11262 - protein, 351 aa, Zea mays
  misc_feature (351)..(351): Xaa can be any naturally occurring amino acid
  unsure (1)..(351): unsure at all Xaa locations
MDQSFGNLGAGAGSSSGGSNSKAAAAAVSSSSFLQLPLSTASPAYYGAPLALLHHAAAAPSSSQQQQQHHHHQYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSLARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGSX

SEQ ID NO: 11263 - protein, 166 aa, Zea mays; identical to SEQ ID NO: 9961
  misc_feature (166)..(166): Xaa can be any naturally occurring amino acid
  unsure (1)..(166): unsure at all Xaa locations

SEQ ID NO: 11264 - protein, 345 aa, Zea mays
  misc_feature (345)..(345): Xaa can be any naturally occurring amino acid
  unsure (1)..(345): unsure at all Xaa locations
SPLPHLCVRALCLFRRQPRGAMAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKAX

SEQ ID NO: 11265 - protein, 326 aa, Zea mays; identical to SEQ ID NO: 10206
  misc_feature (326)..(326): Xaa can be any naturally occurring amino acid
  unsure (1)..(326): unsure at all Xaa locations

SEQ ID NO: 11266 - protein, 164 aa, Zea mays
  misc_feature (164)..(164): Xaa can be any naturally occurring amino acid
  unsure (1)..(164): unsure at all Xaa locations
RPSNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 11267 - protein, 487 aa, Zea mays; identical to SEQ ID NO: 11211
  misc_feature (487)..(487): Xaa can be any naturally occurring amino acid
  unsure (1)..(487): unsure at all Xaa locations

SEQ ID NO: 11268 - protein, 294 aa, Zea mays
  misc_feature (294)..(294): Xaa can be any naturally occurring amino acid
  unsure (1)..(294): unsure at all Xaa locations
GVQDRPAPLPTQQFRSSTPAPAAAASSLAHLLLCGSVRRRSRMASAAGGGAAGEGEWLKVSQLRPMVEAQDPNAKAVDNLTLRRFLRARDHDVDKASAMFLKFLKWRREAAPGGSVPEEQVRRELSQDKLCMGGVDRAGRPILVAFAARHFSAGRDMAEFKSFVVYFFDKICARIPRGQEKFLCIVDLKGWGYSNCDVRAYIAAIEILQNYYPERLGKALMIHVPYIFMKAWKMIYPFIDTNTRDKFVFVEDKSLQETLRREIDEGQLPEFLGGKMDVIPLKDYGVQQQPQAVX

SEQ ID NO: 11269 - protein, 289 aa, Zea mays; identical to SEQ ID NO: 10780
  misc_feature (289)..(289): Xaa can be any naturally occurring amino acid
  unsure (1)..(289): unsure at all Xaa locations

SEQ ID NO: 11270 - protein, 599 aa, Zea mays
  misc_feature (599)..(599): Xaa can be any naturally occurring amino acid
  unsure (1)..(599): unsure at all Xaa locations
MGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVRARGHMLQVLKLDKCSGFSTDALCLVARSCRSLRTLFLEECIIEDEGSEWLHELAVNNSVLVTLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLVTLHPASLX

SEQ ID NO: 11271 - protein, 581 aa, Zea mays; identical to SEQ ID NO: 11134
  misc_feature (581)..(581): Xaa can be any naturally occurring amino acid
  unsure (1)..(581): unsure at all Xaa locations

SEQ ID NO: 11272 - protein, 472 aa, Zea mays
  misc_feature (472)..(472): Xaa can be any naturally occurring amino acid
  unsure (1)..(472): unsure at all Xaa locations
RPPPSGRRSVSLSAQRAEHRRFRDTMMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLRX

SEQ ID NO: 11273 - protein, 358 aa, Zea mays
  misc_feature (358)..(358): Xaa can be any naturally occurring amino acid
  unsure (1)..(358): unsure at all Xaa locations
CMLVEMGSRAAFVVAFLLRAIYAGTQILTKAAFDEGMNTSVFVFYRHLTGILFLVPIAFVLERKTAPPLSFRVSLKLFFHALYGISGAINIYGLGLSYSSATSSSAIFNLLPAVAFFLAVLLGMETLNLKRFHGIAKAAGVLFSTAGVTVLAFYQGPAFRSFIHHTAFSHHNVHAGVVTAAHPKSVWILGIFLTTLSTASWALWTVLQGPMLEAYPSKLLNTTLQMIFATVQCFFIALAAERDLSRWKLALDIRLYAVIYSGILVSGVAYYMQVWVIEKSGPVFLAMTMPITLLVTIILSLFLGEPVTLGSILGGLIMVGGLYSVLWAKRSEQVHASKQQMAAPTPPPAGDTSVGRAX

SEQ ID NO: 11274 - protein, 380 aa, Zea mays
  misc_feature (380)..(380): Xaa can be any naturally occurring amino acid
  unsure (1)..(380): unsure at all Xaa locations
CRLQPMRIERDLHMATGDGETSYTKNSRIQEKTMFQIKPVLEEATRAVYTALHPQTMVVADLGCSSGPNTLRFVSEVIGIIARHCKEYGRQHDHTQLQFFLNDLPGNDFNNLFQLIQQFNKSTAINHKSEAAEALPPPCYISGLPGSYYTRIFPSESVHLFHSLFCLQWRSEAPEGNKKTCLDIYITKTMSPSMVKLFQQQFQKDFSLFLRLRYEELVSGGQMVLTFIGRKHENVFTGESNHLYGLLAQSLKSLVDEGLVEKEKLESFYLPMYSPSVGEVEAILKQVGLFNMNHVKVFQTNWDPYDDLESDVVHNSIRSGENVAKCLRAVMQPLVASQFGEPILDKLFKEYARRVAKHLENEKTKHAIIVLSIEKAIHLX

SEQ ID NO: 11275 - protein, 511 aa, Zea mays; identical to SEQ ID NO: 10153
  misc_feature (511)..(511): Xaa can be any naturally occurring amino acid
  unsure (1)..(511): unsure at all Xaa locations

SEQ ID NO: 11276 - protein, 719 aa, Zea mays
  misc_feature (719)..(719): Xaa can be any naturally occurring amino acid
  unsure (1)..(719): unsure at all Xaa locations
MEVNSSGEETVIKVRKPYTITKQRERWTEAEHKRFLEALKLYGRAWQRIEEHVGTKTAVQIRSHAQKFFTKLEKEAINNGTSPGQAHDIDIPPPRPKRKANSPYPRKSGLSSETPTKELPSDKSTKPNMPLSNENVLMAGDASLQKFQRKELSGKESCSEVLNLFRDAPSPSFSSVNKSSSNHGAPIEASKTKIRDMTIMENSSLNPNMQEDVKEINDQEMERLNGTQISSKCEHSHEGYLDISMQQMKLKPESVETTYVDKQTARASHSLAERTGTTSIPVTATEETHSVLTSDQVGINGSMNPSIHPMFPADPKFDSSATPQPFPHNYAAFAPMMQCNCNQDTHRSLVNMSSTFSSMLVSTLLSNPAIHAAARLAASYWPAAEGNTPIDPNQENLADGVQGRSIGSPPSMASIVAATVAAASAWWATQGLLPFFAPPMAFSFVPAPSAAFPTVDVPRPSEKDRDCPAENAQKECQEARKQGQFEGFRVAASSEYDGSGKGEVSVHTELKISPVQNADATSAAGADTTDAFMNKKKQDRSSCGSNTPSSSDVDVDNVPEKEGNGNEKAKQASCSNSSAGDTNHRRFRSSGSTSDSWKEVSEEGRLAFHALFSREKLPQSFSPPQAEGSKEVGKEEEDEVTTVAVDLNKSTTSIDHDLDTIGEPRASFPNELSPLKLKLRRTGFKPYKRCSVEAKENRVPASDEVGTKRIRLDSEASTX

SEQ ID NO: 11277 - protein, 383 aa, Zea mays
  misc_feature (383)..(383): Xaa can be any naturally occurring amino acid
  unsure (1)..(383): unsure at all Xaa locations
FLIRTGRWKVPAEELGGRKAKPTCSRAGGDSGMERERQAVARNRKVVLRGYIDRAPREEDMELVDGGAVELRVPEGGGGPAVLVKNLYLSCDPYMRGRMRDFRNSYIPPFKPGSPIEGFGVGRVVDSTHPGFSAGDVVSGMTGWEDYSLITNPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYKEEPDLTAALKRHFPEGIDIYFENVGGPMLDAVLLNMRVHGRIAVCGMVSQHGVTAPAGIHNLFSLISKRIAMKGFIQSDYVHLFPQFVDDITRHYRDGKIVYVEDMSVGLESGPASFVGLFSGKNVGKQVVCVSRDX

SEQ ID NO: 11278 - protein, 165 aa, Zea mays
FKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEK

SEQ ID NO: 11279 - protein, 359 aa, Zea mays; identical to SEQ ID NO: 10235
  misc_feature (359)..(359): Xaa can be any naturally occurring amino acid
  unsure (1)..(359): unsure at all Xaa locations

SEQ ID NO: 11280 - protein, 386 aa, Zea mays
  misc_feature (386)..(386): Xaa can be any naturally occurring amino acid
  unsure (1)..(386): unsure at all Xaa locations
RLYSSSSSLYSPSSLLRRPLYTSLVDLDTEVEEGSSQQMDPWISSQPSLSLDLRVGLPPLSLHHQAPVAVALPRSKLLVEENFLLPPPKKEPEVAALETELQRMGEENRRLAEALAEVASKYEALRGQYTEMVAAAATACGNHPSSTSEGGSVSPSRKRKSESTDTAPPAQQLLHQHYPAVAPDQTECTSGEPCKRIREAECKPRVSKLHVHADPADLSLVVKDGYQWRKYGQKVTKDNPCPRAYFRCSFAPACPVKKKVQRSADDPNILVATYEGDHNHGQPPPQAQAPHDGSSPGASKKPPSPPRPVAAAPAPLHHQQVQQHQQQQAVGAVKCEPPVAAAASELIRRNLAEQMAMTLTRDPSFKAAFVTALSGRLFEMSPTKDX

SEQ ID NO: 11281 - protein, 288 aa, Zea mays
KDLLKLEAIQAELIEYNGGQPTFSQWATAAGVDEKTLRKRLNYGIYCKNRMVTSNVRLVISIAREFEGPGMDFYDLIQEGMQGLIRGAEKFDSSKGFRFSTYSHWWIKQAMRKSVSEQSQIFRLPAHMVEASYRVKECTKRLRRKLRRRPTNEEIAVDTGIPIKRVEAAVNLPKYSVSLDSKIGSTDMTYQEVTADPSAETAEEMLNRMSMKKDVHMALDTLTTREKQVVVLRFGLEDGRIRTLQEIGNIMGVSRERIRQIESGAFRKLRSKKKVKALKDYLVPVGNW

SEQ ID NO: 11282 - protein, 278 aa, Zea mays
  misc_feature (278)..(278): Xaa can be any naturally occurring amino acid
  unsure (1)..(278): unsure at all Xaa locations
HTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 11283 - protein, 164 aa, Zea mays
  misc_feature (164)..(164): Xaa can be any naturally occurring amino acid
  unsure (1)..(164): unsure at all Xaa locations
RPPNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGLADWQSSQHPWIYEKX

SEQ ID NO: 11284 - protein, 187 aa, Zea mays
  misc_feature (187)..(187): Xaa can be any naturally occurring amino acid
  unsure (1)..(187): unsure at all Xaa locations
LSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11285 - protein, 437 aa, Zea mays
  misc_feature (437)..(437): Xaa can be any naturally occurring amino acid
  unsure (1)..(437): unsure at all Xaa locations
MSLKSIVRELKEMRDGIGSMSRRGGSGSDGRAFHGRSGSRHSWPSLWAEQQQSHRQGQGLGPGPEGPHHQHQGRWANLPPELLLDVIQRVESSEATWPARRQVVACAAICRSWREVTKEVVKTLEECGRITFPISLKQPGPREMPVQCFVRRERATSTYLLYLGLSPSMNVEKDKLLLAARKVRRATRTYFVISLVSDDFSHSSSTYVGKLKPNFLGTKFTIFDSQPPPDAVVLPNNKTSKRQSKQVSPRLPLGNYNVATVTYELTVLRNRGPRRMQCTMHSIPAECIQEGGKAPTPTGAIQSLDEPVSSTLPSAKGKEVAVEFSSTSLSADLSGPACVNGTPLVLKNKAPRWHEQLQCWCLNFRGRVTVASVKNFQLVASVDPSLNIPAAEQEKVILQFGKIGKDIFTMDYRYPLSAFQAFAICLTSFDTKPACEX

SEQ ID NO: 11286 - protein, 261 aa, Zea mays
  misc_feature (261)..(261): Xaa can be any naturally occurring amino acid
  unsure (1)..(261): unsure at all Xaa locations
RAGAKGMAKRRRHELAPVVEELISPMNSLDDGCLMHIFSFLSPIPDRYNTALVCHRWRFLACHPRLWLRVERPIRDAMEPGVYPDLEAAVSAARPGDTILIAAGGSHVACNIQIKKPICIIGGGDLPDDTVLTCSRGFDNALEFLSTCKIANLTIRAELGCCLLHRGGRLTIQECLLQCEQNPLDHLSFPIISTAIEYDPFSSLKEQGHGVTVVRTRIEGGARAVRTNGTLALRHVRAIYSRSSVFFWFEVGEKVEAPVHX

SEQ ID NO: 11287 - protein, 483 aa, Zea mays; identical to SEQ ID NO: 10000

SEQ ID NO: 11288 - protein, 506 aa, Zea mays
  misc_feature (506)..(506): Xaa can be any naturally occurring amino acid
  unsure (1)..(506): unsure at all Xaa locations
LSFHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11289 - protein, 457 aa, Zea mays
  misc_feature (457)..(457): Xaa can be any naturally occurring amino acid
  unsure (1)..(457): unsure at all Xaa locations
RGLVFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 11290 - protein, 357 aa, Zea mays
  misc_feature (357)..(357): Xaa can be any naturally occurring amino acid
  unsure (1)..(357): unsure at all Xaa locations
HTSKEDTSPEGSGTTERTGAWSNMLNTLMQQASIYGVAAGYCLSASLLSIINKWAVMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLVMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTTKPKAPKVEPKEENDEEQQKLLQMQGVQESSX

SEQ ID NO: 11291 - protein, 296 aa, Zea mays
  misc_feature (296)..(296): Xaa can be any naturally occurring amino acid
  unsure (1)..(296): unsure at all Xaa locations
MMRETYMDVLPPVDHIAARSNWFPAAARLWTAAENKQFERALAGLDLCRPDWEEVARAIPGRTVREVVSHFKHLEVDVQQIESGQVPLPAYGGGASSFTLQWDGYGPGPGDFRHGYRFAGGCGRRHHGRTPEQERKKGVPWTEEEHRLFLLGLKKYGKGDWRNISRNFVQTRTPTQVASHAQKYFIRLNSGGKDKRRSSIHDITTVNLTDDQPPSPSQSSLITSQSNAPAPAPAAGICQVPLAADAKRHGAGTLPFSSPNRTSAAPAYRMEFHDQQGLQCGPLHDQLLASQSVLFX

SEQ ID NO: 11292 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 11293 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11294 - protein, 287 aa, Zea mays
  misc_feature (287)..(287): Xaa can be any naturally occurring amino acid
  unsure (1)..(287): unsure at all Xaa locations
PGSSSPSLSPTTTPGLLRGPGRCRLHQGPQVFLLPRTPRRRRAPPAWFTPNKMSANVGESTSGVSSSDAAGGSFECNICFELPQEPIVTLCGHLFCWPCLYRWLHIHAHSPECPVCKALVEEDKLVPLYGRGKDRVDPRSKNMPEGEIPHRPTGQRPATAPRADANSNFANANANPWFPGTGVPLANARWGNYAFSAAFGGLFPMLSFQVHGFPDAAAYAQPAGFHYGYGHGHGHGFHHGGHMGQAQAHGVHRQAPLGQQQQQADIYLKALLFMIVILVLASLLAFX

SEQ ID NO: 11295 - protein, 296 aa, Zea mays
  misc_feature (296)..(296): Xaa can be any naturally occurring amino acid
  unsure (1)..(296): unsure at all Xaa locations
MMGGWGVSDGYEGSKRTRMMMESNPYFAVNAGSPLDVSKRSRIVEPGPPYFGAMGSNTGGASGGFYQPFNSSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESECRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRHX

SEQ ID NO: 11296 - protein, 355 aa, Zea mays; identical to SEQ ID NO: 11233
  misc_feature (355)..(355): Xaa can be any naturally occurring amino acid
  unsure (1)..(355): unsure at all Xaa locations

SEQ ID NO: 11297 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11298 - protein, 166 aa, Zea mays; identical to SEQ ID NO: 9961
  misc_feature (166)..(166): Xaa can be any naturally occurring amino acid
  unsure (1)..(166): unsure at all Xaa locations

SEQ ID NO: 11299 - protein, 271 aa, Zea mays
  misc_feature (271)..(271): Xaa can be any naturally occurring amino acid
  unsure (1)..(271): unsure at all Xaa locations
MWGFASNAWAAGLEKRSSPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANHGGSPLLNTGRVQASLRKSLSFLVHLTAKFPLVFVFLLIVLYAIPASAAVLLLYILITVLFALPSFLILYFAYPSLDWLVREIFAX

SEQ ID NO: 11300 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11301 - protein, 192 aa, Zea mays; identical to SEQ ID NO: 9976
  misc_feature (192)..(192): Xaa can be any naturally occurring amino acid
  unsure (1)..(192): unsure at all Xaa locations

SEQ ID NO: 11302 - protein, 371 aa, Zea mays
  misc_feature (371)..(371): Xaa can be any naturally occurring amino acid
  unsure (1)..(371): unsure at all Xaa locations
SPRPLSHKASDLSRLRRRFVRVEGRRQEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 11303 - protein, 157 aa, Zea mays
  misc_feature (157)..(157): Xaa can be any naturally occurring amino acid
  unsure (1)..(157): unsure at all Xaa locations
AASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGGGGGYGGGGGGYGGGNRGGGYGNSDGNWRNX

SEQ ID NO: 11304 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11305 - protein, 133 aa, Zea mays
  misc_feature (133)..(133): Xaa can be any naturally occurring amino acid
  unsure (1)..(133): unsure at all Xaa locations
MAQVRGSARGTGSGSSAAALALVLLCALLRGEFAESAVYTVGDRGGWSFNTASWPNGKRFRAGDVLVFRYDARAHNVVPVSAAGYSSCSAPEGARALATGNDRVTLRRGANYFICSFPGHCQAGMKVAVTAAX

SEQ ID NO: 11306 - protein, 272 aa, Zea mays
  misc_feature (272)..(272): Xaa can be any naturally occurring amino acid
  unsure (1)..(272): unsure at all Xaa locations
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAAAANGDKSSPAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRSX

SEQ ID NO: 11307 - protein, 83 aa, Oryza sativa; identical to SEQ ID NO: 11248

SEQ ID NO: 11308 - protein, 182 aa, Oryza sativa; identical to SEQ ID NO: 6611

SEQ ID NO: 11309 - protein, 186 aa, Oryza sativa
  misc_feature (186)..(186): Xaa can be any naturally occurring amino acid
  unsure (1)..(186): unsure at all Xaa locations
GAAAAKAPHKLHRQWAFWYDIQSKPKPGAAWGTSLRKAYTFDTVEEFWGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNVX

SEQ ID NO: 11310 - protein, 340 aa, Zea mays
VQVVQETVVPVPSEEDKEAEAALVHKISSLAAAIAKLPSLSPSPEVNALFTELVTACIPRSSVDVERLGPELQEMRGGLIRLCADAEALLEAHYSDLLASFDNPLEHLSLFPYINNYILLSQLEHGLLARHVPGPAPARVAFVGSGPLPLSSLVLAARHLPGASFDNYDICGEANDRARRLVRGDGALQARMAFRTSDVADVTRELASYDAVFLAALVGMAAEEKARVVAHLGRHMAPGAALVVRSAHGARGFLYPVVDPEEIRRGGFDVLAVHHPEGEVINSVIIARKPVAVDAHATGGVGHAHAHAHGAVLSRPCLCCEMEARAHQKMEEVAVEQLPS

SEQ ID NO: 11311 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 11312 - protein, 175 aa, Zea mays
  misc_feature (175)..(175): Xaa can be any naturally occurring amino acid
  unsure (1)..(175): unsure at all Xaa locations
IPFPKKPRTQPLTMTSSSSPSRKALSKIACNRLQKELAEWQQNPPAGFKHKVSDNLQRWVIEVTGAAGTLYAGEAYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTVX

SEQ ID NO: 11313 - protein, 504 aa, Zea mays
  misc_feature (504)..(504): Xaa can be any naturally occurring amino acid
  unsure (1)..(504): unsure at all Xaa locations
FHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11314 - protein, 158 aa, Zea mays
  misc_feature (158)..(158): Xaa can be any naturally occurring amino acid
  unsure (1)..(158): unsure at all Xaa locations
AEGVGGNRKLRVSNFLGAEAMAGKGGKGLLAAKTTAAKSAEKDKGKKAPISRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKEX

SEQ ID NO: 11315 - protein, 364 aa, Zea mays
  misc_feature (364)..(364): Xaa can be any naturally occurring amino acid
  unsure (1)..(364): unsure at all Xaa locations
QASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 11316 - protein, 272 aa, Zea mays; identical to SEQ ID NO: 11306
  misc_feature (272)..(272): Xaa can be any naturally occurring amino acid
  unsure (1)..(272): unsure at all Xaa locations

SEQ ID NO: 11317 - protein, 308 aa, Zea mays
  misc_feature (308)..(308): Xaa can be any naturally occurring amino acid
  unsure (1)..(308): unsure at all Xaa locations
PRRFRSTGSSAPPTTVRPSVLPATPIRRPVPSHHTLPPLAAMSPSEPTREESVYMAKLAEQAERYEEMVEFMERVARSAGGAGGGEELSVEERNLLSVAYKNVIGARRASWRIISSIEQKEEGRGNEAHAASIRAYRSKIETELARICDGILALLDSHLVPSAGGAESKVFYLKMKGDYHRYLAEFKSGAERKDAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKDAAAPKESAEGQX

SEQ ID NO: 11318 - protein, 289 aa, Zea mays; identical to SEQ ID NO: 9888
  misc_feature (289)..(289): Xaa can be any naturally occurring amino acid
  unsure (1)..(289): unsure at all Xaa locations

SEQ ID NO: 11319 - protein, 333 aa, Zea mays
MGVGKLMNDVKPYLAMVLLQVGFSGMYIVSVASLKRGMNHFVLVVYRNLVATVVMAPFALLFERRVRPKMTPLIFLKIMGLAVLEPVLDQNMYYLGAKLTSATFASALVNILPAITFLLALALRMERLRLRSLRSQAKVVGTVCTVAGAVLMILYHGPVVPFPWSAGRLHHHVPAAAVESQSSASWLNGICMIIGSCLCWSGFFILQSNTLQSYPAELTLTTLICFLGSVLTGGVALVAERRDMSAWVIGFDTRLFTAVYSGIVCSGVAFYVQGIVTQARGPVFVTAFQPLCMIITTVLGSTILKEETTLGSVIGAAIIVVGLYCLIWGKSKD

SEQ ID NO: 11320 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11321 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11322 - protein, 336 aa, Zea mays
MFTPQGKGWTGWSTPTPANQRSGGGAPAASAPLGKGKGRVAELEQELHEYQYNMGLLLIEKKEWAAKFEEISEVLTQKEEILKREQAAHLNAISEYERREENMRKALGVEKQCVADLEKALRDIRAEIAEVKFTSEKKITDAQSLEASLEEKSLEIEGKLHAADAKLAEANRKKSQADRDLEEAEARQRRLEKEKLYFETERKAREKQLKEQEESLQEWEKKLKESQNRLNELQRSINEREERANKNDQLFKIKQDELEEARRTVEAAKVTLKVKEDDINKRLNELHLQEKENELNKKIDFVENKLRHAIELNESKIEKLLLEKREVQMERELLLE

SEQ ID NO: 11323 - protein, 171 aa, Zea mays
  misc_feature (171)..(171): Xaa can be any naturally occurring amino acid
  unsure (1)..(171): unsure at all Xaa locations
GSPGFGFVGERIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGGGGGYGGGGGGYGGGNRGGGYGNSDGNWRNX

SEQ ID NO: 11324 - protein, 352 aa, Zea mays
  misc_feature (352)..(352): Xaa can be any naturally occurring amino acid
  unsure (1)..(352): unsure at all Xaa locations
LAPPPQQPLQPQSPTATMAGAQESLSLVGTMRGHNGEVTAIATPIDNSPFIVSSSRDKSVLVWDLTNPVHSTPESGVTADYGVPFRRLTGHSHFVQDVVLSSDGQFALSGSWDGELRLWDLSTGLTTRRFVGHEKDVISVAFSVDNRQIVSASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQVSKNQILYCTSLSWSADGSTLYTGYTDGSIRVWKISGYGYAGX

SEQ ID NO: 11325 - protein, 172 aa, Zea mays
  misc_feature (172)..(172): Xaa can be any naturally occurring amino acid
  unsure (1)..(172): unsure at all Xaa locations
DPLVVGNVVGDIVDPFITTASLRVFYNNKEMTNGSDLKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIRX

SEQ ID NO: 11326 - protein, 184 aa, Zea mays
  misc_feature (184)..(184): Xaa can be any naturally occurring amino acid
  unsure (1)..(184): unsure at all Xaa locations
LRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11327 - protein, 328 aa, Zea mays; identical to SEQ ID NO: 10220
  misc_feature (328)..(328): Xaa can be any naturally occurring amino acid
  unsure (1)..(328): unsure at all Xaa locations

SEQ ID NO: 11328 - protein, 352 aa, Zea mays
  misc_feature (352)..(352): Xaa can be any naturally occurring amino acid
  unsure (1)..(352): unsure at all Xaa locations
ARPPPLLSPLPHLCVRALCLFRRQPRGAMAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKAX

SEQ ID NO: 11329 - protein, 196 aa, Zea mays
  misc_feature (196)..(196): Xaa can be any naturally occurring amino acid
  unsure (1)..(196): unsure at all Xaa locations
QMVMVSGGGGNAWAKEMTLRRRIASIFNKTQEHFPTLKDYNDYLEEVEDMTFNLIEGIDVEEIEAKIARYQQENAEQIYLSRAKRAEDLAAALKASRMNPVKAEANDTAAGSSQGISGGAGVQGQYAPAAVLGGVAQPRPTGMAPQLIGSGSDPLQGDDEETRRLRAERAARAGGWTAELSKRRALEEAFSAIFIX

SEQ ID NO: 11330 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11331 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11332 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11333 - protein, 420 aa, Zea mays
  misc_feature (420)..(420): Xaa can be any naturally occurring amino acid
  unsure (1)..(420): unsure at all Xaa locations
MELLPVEVVGNILSHLGVARDVMIASAVCRKWRDACRRHLRLLSFNSNDFPRDMTTRQLEIVITQTIFQTIGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYEX

SEQ ID NO: 11334 - protein, 249 aa, Zea mays; identical to SEQ ID NO: 10067

SEQ ID NO: 11335 - protein, 174 aa, Zea mays
ASFVWKTYTMVEDPGTAGVIGWGSGNNSFVVADPFVFSQTLLPAHFKHNNFSSFVRQLNTYGFRKVDPDRWEFAHASFLRGQTHLLRNIVRRGSSAAGAGGGKRKDASPTELASGDDMTMVATEVVRLKQEQRAIDDRVASMWRRVQETERRPKQMLAFLLKVVGDRDRLHRLV

SEQ ID NO: 11336 - protein, 503 aa, Zea mays
  misc_feature (503)..(503): Xaa can be any naturally occurring amino acid
  unsure (1)..(503): unsure at all Xaa locations
HFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11337 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 11338 - protein, 304 aa, Zea mays; identical to SEQ ID NO: 9947
  misc_feature (304)..(304): Xaa can be any naturally occurring amino acid
  unsure (1)..(304): unsure at all Xaa locations

SEQ ID NO: 11339 - protein, 494 aa, Zea mays
  misc_feature (494)..(494): Xaa can be any naturally occurring amino acid
  unsure (1)..(494): unsure at all Xaa locations
ASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11340 - protein, 380 aa, Zea mays; identical to SEQ ID NO: 10029
  misc_feature (380)..(380): Xaa can be any naturally occurring amino acid
  unsure (1)..(380): unsure at all Xaa locations

SEQ ID NO: 11341 - protein, 297 aa, Zea mays
  misc_feature (297)..(297): Xaa can be any naturally occurring amino acid
  unsure (1)..(297): unsure at all Xaa locations
MGAWVSVLLGMDGAAAAGPAAVGLGDLPELCAAQVLLRLDPPEICRLAQVNHAFRGAAGADFVWEAKLPENYNYLMEFVGSGDEGKRRRRRAGKKEIYARLARPVPFGDGKKEFWLDKNKGMICMALSSKALVITGIDDRRYWQHMPTSESRFQSVAYLQQIWWFEVVGEVDFCFPVGTYSLYFRVHLGKFYRRFGRRQCTSEHVHGWDKKPVRFQLSTSDGQQALSQCYLEEPGSWVLYHAGDFVASKPDQLMKLKFSMAQIDCTHTKGGLCIDSVLIYPKGKGFHQERVVRSQKX

SEQ ID NO: 11342 - protein, 640 aa, Zea mays
  misc_feature (640)..(640): Xaa can be any naturally occurring amino acid
  unsure (1)..(640): unsure at all Xaa locations
AHAEERERGCAGRRPASDDAGRRGVVAVKRMRLWEEEDDDEDEEGMEVDGEAEDEPGWPCGAPEAGPGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGYVTHVIGIQLFSEANIDLSSVSYPVYKQKSSSRPSIQDLNSSPHEHAPKIQSADHCGMLQLSDEVLAHNILSRLSPRDVASIGSVCTRMHELTKNDHLRKMVCQNAWGRDVTVRLEMSTKMVGWGRLARELTTLEAASWRKFTVGGRVEPSRCNFSACAVGNRLVLFGGEGVNMQPMDDTFVLNLEAATPEWRRVKVSASPPGRWGHTLSWLNGSWLVVFGGCGQQGLLNDVFVLDLDAQQPTWREVASEGPPLPRSWHSSCTLDGSKLVVSGGCAESGVLLSDTFLLDLTKEKPAWREIPTSWSPPSRLGHTTSVYGATKLFMFGGLAKSGSLRLRSSDAYTVDVSEDSPQWRQLATTTGFPNVSPPPRLDHVAVSLPCGRIIIFGGSIAGLHSPAQLFLIDPAEEKPIWRILNVPGQPPKFAWGHSTCVVGGTRVLVLGGHTGEEWILNELHELCLASRPDEDGX

SEQ ID NO: 11343 - protein, 505 aa, Zea mays
  misc_feature (505)..(505): Xaa can be any naturally occurring amino acid
  unsure (1)..(505): unsure at all Xaa locations
PVPFPHLPDPIREFSLLCRHGALCGEDLVWTGVQGQGSLAGGLRPLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11344 - protein, 505 aa, Zea mays; identical to SEQ ID NO: 10234
  misc_feature (505)..(505): Xaa can be any naturally occurring amino acid
  unsure (1)..(505): unsure at all Xaa locations

SEQ ID NO: 11345 - protein, 648 aa, Zea mays
  misc_feature (648)..(648): Xaa can be any naturally occurring amino acid
  unsure (1)..(648): unsure at all Xaa locations
MSRDLDCPVQTQMAVAVLDRSFSSEYPGGSRTEGRQLSWKRVFVQTDNGSVLGIELERGENVQTVKKKLQIALNVPTDESSLTFGDLVLNDDLSSIRNDSPLLLKRNQIHRSNSTPCLSPTGQDVWQRDRSGPIEILGCSSPSSRMKQIAKDVIKAIMNGVDPVAINSGMGGAYYFKNIWGERVAIVKPTDEEPFAPNNPKGFVGKALGQPGLKRSVRVGETGFREVAAYLLDYDHFANVPPTMLVKITHTIFNVNDCVGCKSKVFCNKSESVSKIASLQEFIPHDFDASDHGTSSFPVSAVHRIGILDIRIFNTDRHAGNLLIKKVGPGADNFGEQTELIPIDHGLCLPECLEDPYFEWIHWPQSSVPFSVEELEYIAKLDPIKDAEMLRVELPMIREACLRVLVLSTVFLKEAAAFGLCLSEIGDMMSRQFTAKEEEPSQLELLCMETRKWVEERELFLPDEAGVEDGDDDFTQFPLDSDAFEPPAFCKFGSVKTSSRNPLSKLDECDEEDGDLSEEEGEHGDVLTSGALPQKVPPISKLSSSMKGLGFIGKSKPYRTGGVPKGKVTGRTNYSGKASEHQSGSRSANELLPPSASFVKLSDMSRKEWSAFLEKFQELLPSALRTRKHSAGVGQRPMPRLGTSCQFX

SEQ ID NO: 11346 - protein, 540 aa, Zea mays; identical to SEQ ID NO: 10189
  misc_feature (540)..(540): Xaa can be any naturally occurring amino acid
  unsure (1)..(540): unsure at all Xaa locations

SEQ ID NO: 11347 - protein, 600 aa, Zea mays
  misc_feature (600)..(600): Xaa can be any naturally occurring amino acid
  unsure (1)..(600): unsure at all Xaa locations
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLIPDDWGAYARPWITELAAPLECLKALHLRRMVVTDDDLAELVRARGHMLQELKLDKCTGFSTHGLRLVARSCRSLRTLFLEECQIDDKGSEWIHDLAVCCPVLTTLNFHMTELEVMPADLKLLAKSCKSLISLKISDCDLSDLIEFFQFATALEEFAGGTFNEQGELSKYVNVKFPSRLCSLGLTYMGTNEMPIMFPFSAILKKLDLQYTFLTTEDHCQLIAKCPNLLVLAVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTKLRRFALYLRPGGLSDAGLGYIGQCSGNIQYMLLGNVGETDDGLISFALGCVNLRKLELRSCCFSERALALAILHMPSLRYVWVQGYKASQTGRDLMLMARPFWNIEFTPPNPKNGGWLMEDGEPCVDSHAQILAYHSLAGKRLDCPQSVVPLYPAX

SEQ ID NO: 11348 - protein, 179 aa, Zea mays
  misc_feature (179)..(179): Xaa can be any naturally occurring amino acid
  unsure (1)..(179): unsure at all Xaa locations
SFRSVRPLAVADHNPLPEDGGMRGQANGVEDRRQRGDDDGEEAEEEEGDDEGRHRGQGPPQQRRHQAQRPNSGPQQQQQPRPPPPLARNVGYVGKHRLSAAIARLDQELQSLQEELDELETMESASAACQEVVTSTEGKPDPLLPVTSGPENSSWDRWFQRVRSRSNKWWASKGPDFSX

SEQ ID NO: 11349 - protein, 227 aa, Zea mays; identical to SEQ ID NO: 10929
  misc_feature (227)..(227): Xaa can be any naturally occurring amino acid
  unsure (1)..(227): unsure at all Xaa locations

SEQ ID NO: 11350 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11351 - protein, 272 aa, Zea mays; identical to SEQ ID NO: 11306
  misc_feature (272)..(272): Xaa can be any naturally occurring amino acid
  unsure (1)..(272): unsure at all Xaa locations

SEQ ID NO: 11352 - protein, 351 aa, Zea mays; identical to SEQ ID NO: 10139

SEQ ID NO: 11353 - protein, 229 aa, Zea mays
  misc_feature (229)..(229): Xaa can be any naturally occurring amino acid
  unsure (1)..(229): unsure at all Xaa locations
RLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPSX

SEQ ID NO: 11354 - protein, 280 aa, Zea mays
  misc_feature (280)..(280): Xaa can be any naturally occurring amino acid
  unsure (1)..(280): unsure at all Xaa locations
QSTHSIPLPTRRIHANAHAPTRHIQMMLRVSPSPAAAVPTQLSGAPATPAPVVRVAAPRGVASPAAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPQLTDFIESEFLEEQVEAINKISKYVAQLRRVGKGHGVWHFDQMLLEEEAX

SEQ ID NO: 11355 - protein, 352 aa, Zea mays
  misc_feature (352)..(352): Xaa can be any naturally occurring amino acid
  unsure (1)..(352): unsure at all Xaa locations
VRVEGRRQEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 11356 - protein, 380 aa, Zea mays; identical to SEQ ID NO: 10029
  misc_feature (380)..(380): Xaa can be any naturally occurring amino acid
  unsure (1)..(380): unsure at all Xaa locations

SEQ ID NO: 11357 - protein, 361 aa, Zea mays
  misc_feature (361)..(361): Xaa can be any naturally occurring amino acid
  unsure (1)..(361): unsure at all Xaa locations
MLRRQGRGGKFLEEVLIVGGLLLVQCVLSGYVVFTDHLLALGADPLAVVVVAGAAYAAFCFPFAVALERKRWPSTVSGTLVAQYLLIALGGTTAFQALMLLGIKKTTPAIASAMPNLSPGLIFIVAACFRLERFDRACKYTQAKMAGTVVCLAGALAMGFLHSPTSTSSSLQAAVAAEAAAGGGDYYYDWILGCCCLVAAVTVFALVTVLQAATLAAFPAPLTMCCATSATGAALTAVLRLVLEGRFLGMGSPRIDATLVAGIVVLGGAAVGACMAFQAWCLGRKGPLFVSVFGPVQTVCTAILSAALLRQVLSLGSLAGIVLMFTGLYIVLWAKSNEISADDEEQSLQGGDDAEKALLAX

SEQ ID NO: 11358 - protein, 369 aa, Zea mays
  misc_feature (369)..(369): Xaa can be any naturally occurring amino acid
  unsure (1)..(369): unsure at all Xaa locations
MDRELLETFDVAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARPVKIEKNSVSASMKLEKRDVDVRGQKPNNAKVEKTTSNGSKAQSVKVERVSKEVIRTPDAKRPASVPNGHPKLTSLVKCNDPTRDKIRELLAEAFVRVSRETSDDDRDEVKNILDEVEACDPYRVAVTVESALFERLGPSTGTHRAKYRSIMFNLRAESNTDFRRRVLIGLVAPERLPDVSPDEMASDARKQENMQIKEKALFDCERGAAPKATTDQFKCARCGQRKTTYYQLQTRSADEPMTTFVTCVNCNNHWKFCX

SEQ ID NO: 11359 - protein, 117 aa, Zea mays
AAAAAVLAAALLLLAAGAGTASAAVSCGEVTSSVAPCLGYAMGSAASPSAACCSGVRSLNSRASSTADRQATCNCLKSMTGRLGGGVSMANAANIPGKCGVSVGVPISPTVDCTKIN

SEQ ID NO: 11360 - protein, 158 aa, Zea mays; identical to SEQ ID NO: 10945
  misc_feature (158)..(158): Xaa can be any naturally occurring amino acid
  unsure (1)..(158): unsure at all Xaa locations

SEQ ID NO: 11361 - protein, 282 aa, Zea mays; identical to SEQ ID NO: 11098
  misc_feature (282)..(282): Xaa can be any naturally occurring amino acid
  unsure (1)..(282): unsure at all Xaa locations

SEQ ID NO: 11362 - protein, 1019 aa, Zea mays
  misc_feature (1019)..(1019): Xaa can be any naturally occurring amino acid
  unsure (1)..(1019): unsure at all Xaa locations
MECNRDEAARAKVLAERKMLDKDFVGAKKLIIKVQQLLKEVEDIDIPKMLTVCDVHCAAGAKVNTEIDWYGILQVPVNADDALIKKQYRKLALLLHPDKNKFGGAEAAFKLVGEANITLTDPSKRYVHDMKRNTFRSVTARPNRQPPKRPAPARSSSTPVNLYNMHQQHQRQASNPTGTQTTFWTICPACGMRYQYYLSILKKALRCQNCLKPFIAHDLKDQAIPSGANQRSAGVWKNAGTPQNSAGPQSNVTGQKGWSATSGVHVNTGSHHANVNTKRKTDGNAGGLKNKMKSAQATRKPSKASSTAGLKRGRRAVFESSESSISETDSDGEVEIPKHGPAENSAGPGQQTRRSSRQKQEVKYNEDSDDDNDDVEDDDNTVEDDFVDSPALKRLRKGGMFHGDHSTKTAKLNEDTAGHNSVNSWGNIKDKKNGGMPCEEKTSNGVEQMKRETMHVGENSDGKEELFHSVSNNGLGLNDDDASDDNKFTFPDPEFFDFDKLRDASQFRANQVWAVYDDQGCMPRFYARITRVKMVPKFMLQFVWLEFNPANKAEEAWSYRGLPVACGHFTHGLSETTSETGMFSRIISLERSKTKNFYEIYPRKGEVWALFKGWDIGWSSDAGIHKKMNHRYEVVQVLSDLTTSTSIIVMPLVKLKGYVSLFVQSGEAAPYVIPQVDTLRFSHCVPHYLTSGTEKEGIPEGSLELDPAALPSNLEEAFPSANPECSSARSQESDSKNAGLSSGNRKGSMNVGQGQHKIAANGRVCTKTTKVENIKHNIDLSEVTDVVDDSICQTEYVCADSEFYDFSVRRSLQRFSPGQIWALYSDIDKFPNYYAFIQKVDLKNDKVQVRWLDVCPQGEVEKRLSQDRTIGIGTFRVGYIHDMMTYTGTDAFSHLVEARPTGRKGEYEILPRLGEIWAVYKNWSAGWTAQDFEKCEYELVEIFGYTDSSIQVQLVRKVDGYKMVFMSYRAGGVKTIRRDEYPKFSHQIPCFHLTHEKGGKLRGYLELDPLSLPEEFLCX

SEQ ID NO: 11363 - protein, 622 aa, Zea mays; identical to SEQ ID NO: 10629
  misc_feature (622)..(622): Xaa can be any naturally occurring amino acid
  unsure (1)..(622): unsure at all Xaa locations

SEQ ID NO: 11364 - protein, 345 aa, Zea mays
  misc_feature (345)..(345): Xaa can be any naturally occurring amino acid
  unsure (1)..(345): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTMKNILGMLLAVMGMVVYSWAVEAEKKAAAPIPRNKGGMLDGEDVPLKARVSGVPAVDLEDGDVKGX

SEQ ID NO: 11365 - protein, 277 aa, Zea mays; identical to SEQ ID NO: 10160

SEQ ID NO: 11366 - protein, 510 aa, Zea mays
  misc_feature (510)..(510): Xaa can be any naturally occurring amino acid
  unsure (1)..(510): unsure at all Xaa locations
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTALDKNMFGGQRLHVCGEGHEPFVSYEGLEQLHRFLFILGITHVLYSFVTVVLSMIKIYSWRKWETLAGPIAAEELKARRTKVMRRQSTFVFNNASHPWSKNKILIWMLCFLRQFKGSIIRSDYLALRLGFVTYHKLPHSYDFHKYMVRSMEDDYNGTIGISWPLWAYAIVCILINVHGINIYFWLSFVPVILVLLVGTELQHVIAQLALEVAEATAPYVGSQLKLRDDLFWFGKPRVLWWLIQFISFQNAFELATFLWSLWELSAQTCFMKHYYMVAIRLISGLLVQFWCSYSTLPLNVIISQMGSKFKKSLVSENVRESLHSWCKRVKDRSRHNPLFSRNGTLTTRSVCSLDTTYETDHETNTVCTLSRTASATSLDDQLTVVTVDDEPSCIEKDVX

SEQ ID NO: 11367 - protein, 401 aa, Zea mays
  misc_feature (401)..(401): Xaa can be any naturally occurring amino acid
  unsure (1)..(401): unsure at all Xaa locations
RNPTHRCPWLRSFHRSATDSRPANSSRGHGSSHMVSWRRSASWLSSASRSSLGAAVGGEAKVTPEADPAAQHDEADEERWSRLLPELLTEIMRRVDAGAERWPPRRDVVVCACVCRRWRDAAVSVVRPPLECGRITFPSSLKQPGPRDAPMHCFIRRDKKISTFSLYLSLTQALTDKGKFLLAARRFRQGAHTEYIISYDYDDLHPRSSSYVGKLRSDFLGTKFIIYDTQAPYDGAKPSRTRSTRRFASKQISPQVSGGNFEVGQVTYRFNFMKSRGPRRMQCNIQCPVGQGSASDPSKEKTPSPSSLDLKNKAPRWHDHLQCWCLNFHGRVTVASVKNFQLVATAGSGGPWGVGDEETVILQFGKIEDDAFTMDYRQPLSAFQAFAICLTSFGTKLACEX

SEQ ID NO: 11368 - protein, 481 aa, Zea mays; identical to SEQ ID NO: 10228
  misc_feature (481)..(481): Xaa can be any naturally occurring amino acid
  unsure (1)..(481): unsure at all Xaa locations

SEQ ID NO: 11369 - protein, 394 aa, Zea mays
  misc_feature (394)..(394): Xaa can be any naturally occurring amino acid
  unsure (1)..(394): unsure at all Xaa locations
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGLELAAVGGDKNWTLGCVYLIGHCLSWSGWLVLQAPVLKKYPARLSVTSYTCFFGVIQFLVIAAFMERDAEAWKFHSGSELFTILYAGFIASGVAFAVQIWCIDRGGPVFVAVYQPVQTLVVAIMASLTLGEKFYLGGIIGAVLIVAGLYLVLWGKSEERARVARDAVSGGDREGLLVAAAAGGGGGGIIRSAGNKVASAATQPLLLPSSTSTDNVX

SEQ ID NO: 11370 - protein, 721 aa, Zea mays; identical to SEQ ID NO: 10593
  misc_feature (721)..(721): Xaa can be any naturally occurring amino acid
  unsure (1)..(721): unsure at all Xaa locations

SEQ ID NO: 11371 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 11372 - protein, 476 aa, Zea mays
  misc_feature (476)..(476): Xaa can be any naturally occurring amino acid
  unsure (1)..(476): unsure at all Xaa locations
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGKWKESEYSGHSIPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGFX

SEQ ID NO: 11373 - protein, 393 aa, Zea mays; identical to SEQ ID NO: 10008
  misc_feature (393)..(393): Xaa can be any naturally occurring amino acid
  unsure (1)..(393): unsure at all Xaa locations

SEQ ID NO: 11374 - protein, 262 aa, Zea mays; identical to SEQ ID NO: 10623
  misc_feature (262)..(262): Xaa can be any naturally occurring amino acid
  unsure (1)..(262): unsure at all Xaa locations

SEQ ID NO: 11375 - protein, 264 aa, Zea mays
MADSGEGRRVCGMPEKAQLHVAMLLLQFGYAGFHVVSRLALNMGISKLVFPVYRNIIALCLLVPFAYFLEKKDRPQLTLNFVVQFFLLALCGITANQGFYLLGLDNTSPTFASAIQNSVPAITFAMAAALRIEKVRLDRRDGVAKVAGTLACVAGASVITLYKGPTIFGPSGSGGGGGLELAAVGGDKNWTLGCVYLIGHCLSWSGWLVLQAPVLKKYPARLSVTSYTCFFGVIQFLVIAAFMERDAEAWKFHSGSELFTILYA

SEQ ID NO: 11376 - protein, 449 aa, Zea mays; identical to SEQ ID NO: 10586
  misc_feature (449)..(449): Xaa can be any naturally occurring amino acid
  unsure (1)..(449): unsure at all Xaa locations

SEQ ID NO: 11377 - protein, 500 aa, Zea mays
  misc_feature (500)..(500): Xaa can be any naturally occurring amino acid
  unsure (1)..(500): unsure at all Xaa locations
MTATPAVIGLSARGNRLLATSFGSAELAPPDAYPSRQFAAAAPKLTVVAHRASASASSPADIGGAGHARAHAIRALRNHSAPALAPPPPADPAPELDSKFEFEFESSLEAIVLLQRSMLEKQWELPFEDDISSTEDEDEDERSTVVVARSGVSARQRRMSGRRRGAVVGRKSVTVSPELMQSRNRIYLRGTVSKDLLTHKQVVQLSRKIKDGIWLQHQRSKLKEKLGNEPSYKQLAQSLRIPAPELRARMRESFLAREMLAMSNTRLVISIAQKYDNLGVELPDLIQGGLIGLLRGIEKFDASRGFRISTYVYWWIRQGVSRALADNSRSFRLPTYLHERLVAIRGAKYALEDQGIAPTVENIAESLNISEKKVHNATEAVHKVISLDQQAFPSLNGLPGDTLHSYIEDQNVANDPWHGFEERYLKEEVNSLINSTLNERERDIIRLYHGIGKQCHTWEDISRQFGLSRERVRQVGLVAMEKLKHAARREHLDALLEEYX

SEQ ID NO: 11378 - protein, 367 aa, Zea mays; identical to SEQ ID NO: 10237
  misc_feature (367)..(367): Xaa can be any naturally occurring amino acid
  unsure (1)..(367): unsure at all Xaa locations

SEQ ID NO: 11379 - protein, 571 aa, Zea mays
  misc_feature (571)..(571): Xaa can be any naturally occurring amino acid
  unsure (1)..(571): unsure at all Xaa locations
SLLPTSFHFLSLLLLVLASCSAECWIRGCSKGSKSLLVFPVERGTGGENPQPRRCKFPTAGAGFSCGNMRKLLFISFVLSLSAAAVHGEDGAYIGVNIGTAMSSVPAPTQITTLLRSQNIRHVRLYDADPAMLAALSNTGIRVIVSVPNEQLLAIGNSNATAANWVARNVAAHFPAVNITAIAVGSEVLSAQPSAAPLLMPAMRYLQNALVAAALDRYIKVSTPHSSSIILDSFPPSQAFFNRSLDGVLVPMLRFLQSTGSPLMLNVYPYYDYMRSNGVIPLDYALFRPLPPNKEAVDANTLLHYTNVFDAVVDAAYFAMAYLNVTNVPVMVTETGWPHKGDSSSEPDATSDNADTYNSNLIRHVMNSTGTPKHPGVAVPTYVYELYDEDTRPGSTSEKYWGLFDMDGVPAYTLHLTGSGVLLANDTTNQTYCVAREGADPKMLQAALDWACGPGKVDCSVLMQGQPCYDPDTVDAHATYAFNAYYHGMGMGSGTCYFSGVAVVTTTDPSHGSCVYAGKNGTSLMNGTSLAPSSNSTEGGSGAHRAFGDVSSLVRIVSTALLFSVVLLLLX

SEQ ID NO: 11380 - protein, 345 aa, Zea mays; identical to SEQ ID NO: 9895
  misc_feature (345)..(345): Xaa can be any naturally occurring amino acid
  unsure (1)..(345): unsure at all Xaa locations

SEQ ID NO: 11381 - protein, 506 aa, Zea mays
  misc_feature (506)..(506): Xaa can be any naturally occurring amino acid
  unsure (1)..(506): unsure at all Xaa locations
LPFHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11382 - protein, 540 aa, Zea mays
  misc_feature (540)..(540): Xaa can be any naturally occurring amino acid
  unsure (1)..(540): unsure at all Xaa locations
MACLAPQFKWAPSAAAHMPSSSSSSSYSRCSALRVHCAVTSAAVVEDRTNGSAAQLRLAYAAPAIQRNFEATLASEALLNEEAVVAAAAAEAVALARAAAEAAQEVVQIVQRNNHQPVIRPKKCVDNYLANEILRTEMRSSSPDMYANNPLMEYLDSYGIMDAEDELDAYAQYTENIAVKSARQSERKARRTRAAIKASTTLHASQKVALSSKKKRSKGSSSSMNPLGSLWKMTGRRLLTAKEEVEFSEGIQDLLKLEAIQAELIEYNGGQPTFSQWATAAGVDEKTLRKRLNYGIYCKNRMVTSNVRLVISIAREFEGPGMDFYDLIQEGMQGLIRGAEKFDSSKGFRFSTYSHWWIKQAMRKSVSEQSQIFRLPAHMVEASYRVKECTKRLRRKLRRRPTNEEIAVDTGIPIKRVEAAVNLPKYSVSLDSKIGSTDMTYQEVTADPSAETAEEMLNRMSMKKDVHMALDTLTTREKQVVVLRFGLEDGRIRTLQEIGNIMGVSRERIRQIESGAFRKLRSKKKVKALKDYLVPVGNWX

SEQ ID NO: 11383 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11384 - protein, 349 aa, Zea mays
  misc_feature (349)..(349): Xaa can be any naturally occurring amino acid
  unsure (1)..(349): unsure at all Xaa locations
MAEQAGAGRYWCHMCAAAVSPAEGEVEMKCPFCHSGFLEEMETARGAATDDGDGDGDGAVAQVHPGADRPSSIWAHAILSTVDSSARRRRNRRQQEAASDVYDWNDPEFSLRRRRVTAFLRLLHELRDRQLQRLESAAGVALEGDQLTPFGRSLFIGAAGGEHGVALGDYFLGPSLDALVQQLAENDAARHGTPPAKKEAVEAMPTVEIAGGNDGDDAASCPVCLEDYAAGERAREMPCRHRFHGNCIVPWLEMHSSCPVCRFQLPATDDKSSCSGGDGGFVSVDADREGSDNGGGDGRASSPGNAELAEAEESGRRLPPSLQWLNSLFSPSAQSSGSGGSSSHHWENX

SEQ ID NO: 11385 - protein, 489 aa, Zea mays
  misc_feature (489)..(489): Xaa can be any naturally occurring amino acid
  unsure (1)..(489): unsure at all Xaa locations
MAGNALANYVQVYVMLPLDVITVDNTFEKEDETRAQLKKLTEAGADGVMIDVWWGLVEGKEPGVYDWSAYRQVFKLVQEAGLKLQAIMSCHQCGGNVGDVVNIPIPQWVRDVGKSNPDIFYTNRSGLTNIEYLTLGVDDQPLFHGRTAIQLYADYMKSFRENMADFLDAGVVVDIEVGLGPAGEMRYPSYPQSQGWVFPGVGEFICYDKYLQADFKAAAEEAGHPEWDLPDDAGTYNDTPEKTQFFADNGTYQTDKGKFFLTWYSNKLIKHGDKILDEANKVFLGCKVQLAIKVSGIHWWYNVPNHAAELTAGYYNLDDRDGYRTIAHMLTRHRASMNFTCAEMRDSEQSSEAKSAPEELVQQVLSAGWREGLNLACENALNRYDATAYNTILRNARPQGINKNGPPEHKLHGFTYLRVSDELFQEQNYTTFKTFVRRMHANLDYNPNVDPVAPLERSKAEIPIEEILEVAQPKLEPFPFDKDTDLPVX

SEQ ID NO: 11386 - protein, 197 aa, Zea mays
  misc_feature (197)..(197): Xaa can be any naturally occurring amino acid
  unsure (1)..(197): unsure at all Xaa locations
YLSPTVSSVCENPILQPYRIQQAIAAGILPLSPLFLQQSSALLQQLPLVHLLAQNIRAQQLQQLVLANLAAYSQQQQFLPFNQLAALNSASYLQQQQLPFSQLSAAYPQQFLPFNQLTALNSPAYLQQQQLLPFSQLAGVSPATFLTQPQLLPFYQHAAPNAGTLLQLQQLLPFNQLALTNPAAFYQQPIIGGALFX

SEQ ID NO: 11387 - protein, 366 aa, Zea mays
  misc_feature (366)..(366): Xaa can be any naturally occurring amino acid
  unsure (1)..(366): unsure at all Xaa locations
AMSGMAARIGEWKPVMAMLIFDLISAVTTALIKKALQEGLDRLVLITLRQLVATVFLAPIAYFRERSTRPKLTLEILVYLFFSAAFGAALSQYTFFYGLQYTTATFAITFTNVAPVLTFLIAVLLRVESLSMKNKAGAAKIAGTLTSFAGVMLLTLYKGVSLTHQQAGEASPEDHNLGAAAASPSDRKSWTLGTLALLANCLCFSFWLLLQSRLTKKYPALYSSTAYMFLISSMQGGALTAAIQRRASVWLLTRPIEIVTVLYTGIMGSGVGYVLMTWCVEKRGPVFTSAFIPVIQIMVAMVDFFFLHENLYLGSVLGSILLILGLYILLWGKKRDASSSAAAKEEEDGEKEDEEEEDKEKQVRSX

SEQ ID NO: 11388 - protein, 484 aa, Zea mays
  misc_feature (484)..(484): Xaa can be any naturally occurring amino acid
  unsure (1)..(484): unsure at all Xaa locations
SSSRTAPFASFRQLHSSWPPHYLLFAAAATAPPGSQPAMDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRTHQGLDLTRVTTRELIAKYGLSDDTVDFIGHALALHRDDRYLDEPALDTVKRMKLYSESLARFQGGSPYIYPLYGLGELPQGFARLSAVYGGTYMLNKPECKVEFDMEGKVCGVTSEGETAKCKKVVCDPSYLPNKVRKIGRVVRAIAIMSHPIPNTNESHSVQIILPQKQLGRRSDMYVFCCSYTHNVAPRGKFIAFVSAEAETDNPQSELKPGIDLLGSVDEILYDIYDRYEPVNEPSLDNCFVTTSYDATTHFETTVTDVLNMYTMITGKTVDLSVDLSAASAAEEYX

SEQ ID NO: 11389 - protein, 237 aa, Zea mays
  misc_feature (237)..(237): Xaa can be any naturally occurring amino acid
  unsure (1)..(237): unsure at all Xaa locations
PTMAAKIFCLLMLLGLSASAATATIFPQCSQAPIASLLPPYLSPVVSSVCENPILQPHRIQQAIAAGILPLSPLFLQQSSALLQQLPLVHLLAQNIRAQQLQQLVLANLAAYSQQHQFLPFNQLAALNSVSYLQQQQLPFNQLAAAYPQQFLPFNQLAALNSPAYLQRQQLLPFSQLAGVSPAAFLTQPQLLPFYQHAAPNAGTLLQLQQLLPFNQLALTNPAVLYQQPIIGGALFX

SEQ ID NO: 11390 - protein, 353 aa, Gossypium hirsutum
  misc_feature (353)..(353): Xaa can be any naturally occurring amino acid
  unsure (1)..(353): unsure at all Xaa locations
REWQWKMAASSDPNPEGSDEQQKRSEIYTYEAPWHIYAMNWSVRRDKKYRLAIASLLEHYNNRLEIVQLDDSNGEIRSDPNLSFDHPYPPTKTIFIPDKECQKPDLLATSSDFLRIWRISDDHSRVDLKSLLNGNKNSEFCGPLTSFDWNEAEPKRIGTSSIDTTCTIWDIERETVDTQLIAHDKEVYDIAWGGVGVFASVSADGSVRVFDLRDKEHSTIIYESSEPDTPLVRLGWNKQDPRYMATIIMDSAKVVVLDIRFPTLPVVELQRHQASVNAIAWAPHSSCHICTAGDDSQALIWDLSSMSQPVEGGLDPILAYTAGAEIEQLQWSSSQPDWVAIAFSTKLQILRVX

SEQ ID NO: 11391 - protein, 258 aa, Zea mays; identical to SEQ ID NO: 11013
  misc_feature (258)..(258): Xaa can be any naturally occurring amino acid
  unsure (1)..(258): unsure at all Xaa locations

SEQ ID NO: 11392 - protein, 417 aa, Zea mays
  misc_feature (417)..(417): Xaa can be any naturally occurring amino acid
  unsure (1)..(417): unsure at all Xaa locations
MGGVGEGDAWADQEQGNGGGSRGVGGGGGEAKRSEIYTYEAAWHIYAMNWSVRRDKKYRLAIASLLEQVTNRVEVVQLDEASGDIAPVLTFDHQYPPTKTMFMPDPHALRPDLLATSADHLRIWRIPSSDDAEDGAASANNNNGSVRCNGTQQPGIELRSELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSGGGSNSGAGDGGTASPTPLVRLGWNKQDPRYMATIIMDSPKVVVLDIRYPTLPVVELHRHHAPVNAIAWAPHSSCHICTAGDDMQALIWDLSSMGTGSNGSGNGNGNTAAGAAAEGGLDPILAYTAGAEIEQLQWSATQPDWVAIAFANKLQILRVX

SEQ ID NO: 11393 - protein, 410 aa, Zea mays
  misc_feature (410)..(410): Xaa can be any naturally occurring amino acid
  unsure (1)..(410): unsure at all Xaa locations
MAVVAGDSESLMQRCKPYVAMISLQFGYAGMNVITKVSLNHGMSHYVLVVYRHAFATLSIAPFALVLERKVRPRMTLWAFLQIFVLALLGPVIDQNFYYAGLKFTSPTFSCAMSNMLPAMTFVLAVLFRMEKVNLKKARCVAKVVGTLVTVAGAMLMTLYKGRVVELVWTKHIHLHGPHPDAAAAAAAADKDWFTGSIFLIIATLAWASLFILQAATLKRYDAPLSLTTLICFVGTLQAIVVTFVMEREPSVWRIGFDMNLLAAAYAGIVTSSIAYYVQGLVIQSRGPVFASAFSPLMMIIVAIMGSFILAENIYLGGIIGSVLIVAGLYSVLWGKHKENEEKEGEAAMEIPVAIKAVDGNGRIMEIVELDEVQLEKAQANTNANANAAVAVTAVPAAEARMQGKDDQAX

SEQ ID NO: 11394 - protein, 282 aa, Zea mays
  misc_feature (282)..(282): Xaa can be any naturally occurring amino acid
  unsure (1)..(282): unsure at all Xaa locations
QFPDHTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 11395 - protein, 436 aa, Zea mays; identical to SEQ ID NO: 10163
  misc_feature (436)..(436): Xaa can be any naturally occurring amino acid
  unsure (1)..(436): unsure at all Xaa locations

SEQ ID NO: 11396 - protein, 489 aa, Zea mays
  misc_feature (489)..(489): Xaa can be any naturally occurring amino acid
  unsure (1)..(489): unsure at all Xaa locations
MLNCSRKMGRSASVLQVLLVSATIVVAQTQWASGVWGMYCEDLTASAERPHRASVTDFGAVGDGATLNTKAFQNALFHLDSFAKKGGAQLFVPAGRWLTGSFSLISHLTLSLDKDAVILGSPDSSDWPVIDALPSYGRGRELPGKRHQSLIFGSNLTDVIITGANGTVDGQGAVWWDWFHNHTLNYTRPPLVELMYSTRVVISNLTFINSPFWNIHPVYCSQVLVQHLTILAPISSPNTDGIDPDSSTNVCIEDCYVRNGDDIVVIKSGWDEYGISFAHPSSNISIRNITGQTRNSAGLAFGSEMSGGISDVRAEGVRIVNSVHGIRIKTAPGRGGYVKNVYVADVSFDNVSIAIRITGNYGEHPDDGYDRNALPTISNITIKDVVGVNIGVAGMLQGIPGDSFSGICLSNVSLSVRSTDPWNCSLVEGYSSSVSPEVCEQLRATPGSGQMCYGGNYPAAAAQPQPPQKSGASRLVSPFLSISWFLRRX

SEQ ID NO: 11397 - protein, 425 aa, Zea mays
  misc_feature (425)..(425): Xaa can be any naturally occurring amino acid
  unsure (1)..(425): unsure at all Xaa locations
MAARAADENRRPAAGKPAPGVRDMASRRALTDIKNLVGAAPYPYAVAKKPMLQKSKRDEKQPALASSRPMTRKFVASLASKGQPECQPIVADPEPEVCQQKESVGDGTVDIDVELYELVDGSDSDIDMGATENKDIMNEDELLMDIDSADSGNPLAATEYVKELYTFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGANX

SEQ ID NO: 11398 - protein, 229 aa, Zea mays
  misc_feature (229)..(229): Xaa can be any naturally occurring amino acid
  unsure (1)..(229): unsure at all Xaa locations
RSLLPIGSTPPRNWKLRFNLPYSSAASNTADAAAAGGSLDVLLCSHLVSAQELFTMARVYVGNLDSRVTSGELEDEFRVFGVLRSVWIARKPPGFAFIDFDDRRDAEDAIRDLDGKNGWRVELSRNSSGRGGRDRYGGSESKCYECGETGHFARECRLRIGSGGLGSGRRRSRSRSRSRSRSRSRSRSRSPRYRRSPSYSRRSYSPRYRSPRRRSPSPTRARSYSRSPX

SEQ ID NO: 11399 - protein, 429 aa, Zea mays
  misc_feature (429)..(429): Xaa can be any naturally occurring amino acid
  unsure (1)..(429): unsure at all Xaa locations
MASAGNSGSGDDDAGGKLLADRYQKGEVLGEGTYGVVFKAIDTKTGNTVAVKRIRIGKDKKEGVNFTALREIKLLKELKDPNIIELIDCFPYKENLHLVFEFMETDLEALIKDKNIILSPADTKSYVQMMLKGLAFCHKKWVLHRDMKPNNLLIGADGQLKLADFGLARVFGSPGRNFTHQVFARWYRAPELLFGSKQYGSGVDIWAAGCIFAELLTRRAFLQGSSDIDQLGKIFAALGTPKSSQWPDMVYLPDYVEYQYVAAPPLRTLFPMASDDALDLLSKMLTYDPKARISAQQALEHRYFSSLPAPTRPSQLPRPRRKGDQGNNKIPDLNLQDGPMVLSPPRKLRRVTAHEGMEGMHRTDKVDEHPSGMRHTDDMPSQSSRIPMSVDVGAVFGTRPAPRPTLNSADKSRLKRKLDMDPEFGYAEX

SEQ ID NO: 11400 - protein, 358 aa, Zea mays
VPMIHDTSSSRASTACHYSPSLVAEEQLHGSKDTLTLKGEKALLELLLGMALDQHVDGRKLITQQEAEDSDFESYLREATSRVLYQPTFMYGASEFISSEEDDDDSISESSSASLAKPAGTLDLGKLTEEPQLDVPQPHRRSVDPNHSYDQVFIRSTRLLERRSKKRNGGHRALDNGVACSGVNSKRKDKFGRVLDPDEPFRLFLRDRETTEFLTAKEEKQMFSQIQDLMKLEEAQRNLQAQCGREPTVEEWAQAVGMSCRELQSCVRTGRRCREKMARSNFRLVIHVARKYEGCGLDIQDLVQDGCCGLMKTFEKFNPSKGCRFPTYAYWWIRQSIKKSIFKNSRLIRLPVLIDCLL

SEQ ID NO: 11401 - protein, 952 aa, Zea mays
  misc_feature (952)..(952): Xaa can be any naturally occurring amino acid
  unsure (1)..(952): unsure at all Xaa locations
MGGLEEIKNEAVDLENIPIEEVFEQLKCTREGLSSSEGQQRLEIFGPNRLEEKKESKVLKFLGFMWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLENKTAFTTKKDYGREEREAQWATAQRTLHGLQPPEASSNTLFNDKSSYRELSEIAEQAKRRAEIARLRELNTLKGHVESVVKLKGLDIDTIQQNYTVX

SEQ ID NO: 11402 - protein, 340 aa, Zea mays
  misc_feature (340)..(340): Xaa can be any naturally occurring amino acid
  unsure (1)..(340): unsure at all Xaa locations
MLQGSEVMGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSPX

SEQ ID NO: 11403 - protein, 338 aa, Zea mays; identical to SEQ ID NO: 10555

SEQ ID NO: 11404 - protein, 498 aa, Zea mays
  misc_feature (498)..(498): Xaa can be any naturally occurring amino acid
  unsure (1)..(498): unsure at all Xaa locations
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDSVVAKKSVLEIEREVAARWRNAVNKKKTGVCX

SEQ ID NO: 11405 - protein, 402 aa, Zea mays
  misc_feature (402)..(402): Xaa can be any naturally occurring amino acid
  unsure (1)..(402): unsure at all Xaa locations
MSFRSLIQDMKDEFGSISRHSLRSRSHRSAGNAARAVAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSVPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACEX

SEQ ID NO: 11406 - protein, 347 aa, Zea mays
  misc_feature (347)..(347): Xaa can be any naturally occurring amino acid
  unsure (1)..(347): unsure at all Xaa locations
IPNGDCSFARRCLSPHPLPLLLISSQSPSLSLFLASWFVPHPPPHWVPRRDAMEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQGWPGVSCLPDFKTAFPRWQAQDLATIVPNLEPAGLDLLSKMLRYEPSKRITARQALEHEYFKDLEMVQX

SEQ ID NO: 11407 - protein, 319 aa, Zea mays
  misc_feature (319)..(319): Xaa can be any naturally occurring amino acid
  unsure (1)..(319): unsure at all Xaa locations
VCVRGAGAGAMEINIVDKYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQFX

SEQ ID NO: 11408 - protein, 163 aa, Zea mays
  misc_feature (163)..(163): Xaa can be any naturally occurring amino acid
  unsure (1)..(163): unsure at all Xaa locations
PSNKCQRPLAVAAMESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEKX

SEQ ID NO: 11409 - protein, 391 aa, Zea mays; identical to SEQ ID NO: 10127
  misc_feature (391)..(391): Xaa can be any naturally occurring amino acid
  unsure (1)..(391): unsure at all Xaa locations

SEQ ID NO: 11410 - protein, 445 aa, Zea mays
  misc_feature (445)..(445): Xaa can be any naturally occurring amino acid
  unsure (1)..(445): unsure at all Xaa locations
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAGSGRSVQKNRRKKPACTLSTVLSARSKAACGLTEKPKEPIEDIDKFDGDNQLALVDYVEDIYTFYKTAQHESRPIDYMGNQPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTGLNEQQIMEGAKTLVGSHAASASPDARLKAVYQKYATEQFGRVALHPPAPTALPDLVX

SEQ ID NO: 11411 - protein, 482 aa, Zea mays
  misc_feature (482)..(482): Xaa can be any naturally occurring amino acid
  unsure (1)..(482): unsure at all Xaa locations
DAGDASTALALTAAEPSPPSPNRRGKRPTNPPKRFVHTPIPPSILSDPTLAAAATSLLPANYNFELHKTAHRIRSAAARRVALQLPEGLLLFALPLSHLLAPYLEPGADNDVLVLADATYGACCLADRPARALAADLLVHYGHSCLVPVTASLLPVLYVFVEIRVDAARLAAAVRAAFPDPAAAPRLAIAGTVQFIAAVHAAREMLTVEGYHDIVVPQAKPLSAGEILGCTAPTLKKSEEVGAVVFVADGRFHLEAFMIANPGVKAYRFDPFLGVLVLEEYDHVGMKQARKAAVLAARKAKSWGVVLGTLGRQGSTKVLDRVVEHLEEKELEHTVVLMSELSPARMELFGDSIDAWVQIACPRLSIDWGEGFKKPVLTTFEFDVALGYVPGWWEKGSRGCGSECGVGCCSGSGTRGNCNCSDGDYGGDYPMDYYSQDGGDWNSCYMKKKPSTGERKLRVRIGNEIQAEEKRGNQDSRELVRX

SEQ ID NO: 11412 - protein, 179 aa, Zea mays
  misc_feature (179)..(179): Xaa can be any naturally occurring amino acid
  unsure (1)..(179): unsure at all Xaa locations
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISNX

SEQ ID NO: 11413 - protein, 366 aa, Zea mays
  misc_feature (366)..(366): Xaa can be any naturally occurring amino acid
  unsure (1)..(366): unsure at all Xaa locations
MVMMMRSCLGGGLLPVAVMLCLNVVAAVMVSLVKVAMDGGMKPLVIVTLQQLTAAVFLAPIAFFKERKSRPKLTLEIFAYIFVSAALGAALRQYMIFVALRYTTATFVTAFSNIAPVLTFLLAVATRSEALDLKSRTGLAKLLGTLVSLAGAMVLTLYKGVALTHAAAASQDHQQHSHGRLPPSAADSRGKWTLGTVAILGNCVCLSCWFLLHGRLAKKYPHVYSCNALMSLLSFLQVAVVGLCTQRSISPWIVTSKFNILTVLYAGIVGCGVSFVLVTWCIEKRGAVFVAAFIPVVQIIVSVIDFSILHEQLYLGSVLGSVLVIGGLYLLLWGKRQEALHCPPPPPKVAEEDPADKEQQQVQHNX

SEQ ID NO: 11414 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11415 - protein, 249 aa, Zea mays; identical to SEQ ID NO: 9907

SEQ ID NO: 11416 - protein, 231 aa, Zea mays
  misc_feature (231)..(231): Xaa can be any naturally occurring amino acid
  unsure (1)..(231): unsure at all Xaa locations
GKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 11417 - protein, 291 aa, Zea mays
  misc_feature (291)..(291): Xaa can be any naturally occurring amino acid
  unsure (1)..(291): unsure at all Xaa locations
HTHFTQRGGRRPPAMEAVARSGDYLWRFVAETEWYNEVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFGTLNEPEDILKKAX

SEQ ID NO: 11418 - protein, 952 aa, Oryza sativa
  misc_feature (952)..(952): Xaa can be any naturally occurring amino acid
  unsure (1)..(952): unsure at all Xaa locations
MGGLEEIKNEAVDLENIPIEEVFEQLKCTREGLSSEEGNRRIEMFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKIDQSALTGESLPVTKNPGDEVFSGSTCKQGEIEAVVIATGVHTFFGKAAHLVDSTNQVGHFQTVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFTKGVDKDHVLLLAARASRTENQDAIDAAMVGMLADPKEARAGIREVHFLPFNPVDKRTALTYIDADGNWHRASKGAPEQILTLCNCKEDVKRKVHAVIDKYAERGLRSLAVARQEVPEKSKESAGGPWQFVGLLPLFDPPRHDSAETIRKALHLGVNVKMITGDQLAIGKETGRRLGMGTNMYPSSALLGQNKDASLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFLLIALIWKYDFSPFMVLIIAILNDGTIMTISKDRVKPSPLPDSWKLKEIFATGIVLGSYLALMTVIFFWAMHKTDFFTDKFGVRSIRNSEHEMMSALYLQVSIVSQALIFVTRSRSWSFIERPGLLLVTAFMLAQLVATFLAVYANWGFARIKGIGWGWAGVIWLYSIVFYFPLDIFKFFIRFVLSGRAWDNLLENKIAFTTKKDYGREEREAQWATAQRTLHGLQPPEVASNTLFNDKSSYRELSEIAEQAKRRAEIARLRELNTLKGHVESVVKLKGLDIDTIQQNYTVX

SEQ ID NO: 11419 - protein, 256 aa, Oryza sativa
  misc_feature (256)..(256): Xaa can be any naturally occurring amino acid
  unsure (1)..(256): unsure at all Xaa locations
KGKFGMRVAATTRPASSSAAAPLPLFLLLAVAAAAAALFLVGSASLAMAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFVKFDILMKLKRGNKEEKFKAEVHKNLEGAFVLNQMQQEHDESSSQX

SEQ ID NO: 11420 - protein, 302 aa, Zea mays
  misc_feature (302)..(302): Xaa can be any naturally occurring amino acid
  unsure (1)..(302): unsure at all Xaa locations
KYEKLEKVGEGTYGKVYKAQDKATGQLVALKKTRLEMDEEGIPPTALREISLLNLLSHSIYIVRLLAVEQAAKNGKPVLYLVFEFLDTDLKKYLDVYRRGPSARPLPATLIKNFLYQLCKGVAHCHSHGVLHRDLKPQNLLVDKEKGILKIADLGLGRAFTVPMKSYTHEIVTLWYRAPEVLLGATHYSTGVDMWSVGCIFAEMARRQALFPGDSELQQLLHIFRLLGTPTEEQWPGVSDLRDWHEFPQWKPQGLARVVPTLEPEGVDLLSKMLQLDPSNRISALAAMEHPYFNSLDKSQFX

SEQ ID NO: 11421 - protein, 576 aa, Oryza sativa
  misc_feature (576)..(576): Xaa can be any naturally occurring amino acid
  unsure (1)..(576): unsure at all Xaa locations
SSYVSAAPHFLHSISFLGLSSSDTGVCRFVFVRGASAMARGSGAGGGGGGGGGGLELSVGVGGGGGARGGGGGEATAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGHX

SEQ ID NO: 11422 - protein, 654 aa, Oryza sativa
  misc_feature (654)..(654): Xaa can be any naturally occurring amino acid
  unsure (1)..(654): unsure at all Xaa locations
APTLSPFPPPPPRYFPTSAAAAAMESGLVASHRLRVPFAAAHHRHHPAAPPHLLRQRRGSVAATPLRLGLHLPTPTPLRLPAALPLRPSLPPLRAAAASAAAPEPVGSASPKFLGVETKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKVSQEPESTTSEKSGQQSQX

SEQ ID NO: 11423 - protein, 408 aa, Oryza sativa
  misc_feature (408)..(408): Xaa can be any naturally occurring amino acid
  unsure (1)..(408): unsure at all Xaa locations
LQHPELQSPTPFRPRILPLSIDRSIMVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKAX

SEQ ID NO: 11424 - protein, 408 aa, Oryza sativa
  misc_feature (408)..(408): Xaa can be any naturally occurring amino acid
  unsure (1)..(408): unsure at all Xaa locations
LQHPELQSPTPFRPRILPLSIDRSIMVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGPKDPRYFSKLTTNADSDCLLRINHYPPSCNIHKLDHDDQCIIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKAX

SEQ ID NO: 11425 - protein, 407 aa, Oryza sativa
  misc_feature (407)..(407): Xaa can be any naturally occurring amino acid
  unsure (1)..(407): unsure at all Xaa locations
QHPELQSPTPFRPRILPLSIDRSIMVVPSATTPARQETVVAAAPPAAAASGVVGGGGGVTIATVDMSAERGAVARQVATACAAHGFFRCVGHGVPAAAPVAARLDAATAAFFAMAPAEKQRAGPASPLGYGCRSIGFNGDVGELEYLLLHANPAAVAHRARTIDAMDPSRFSAIVNEYIEAMKKLACEILDLLGEGLGLKDPRYFSKLTTNADSDCLLRINHYPPSCNIHKLDHDDQCNIKSLVSTKASNGGNLMAGGRIGFGEHSDPQILSLLRANDVEGLQVFVPDHEGKEMWVQVPSDPSAIFVNVGDVLQALTNGRLISIRHRVIATACRPRLSTIYFASPPLHARISALPETITASSPRRYRSFTWAEYKTTMYSLRLSHSRLELFKIDDDDSDNASEGKAX

SEQ ID NO: 11426 - protein, 609 aa, Triticum aestivum
  misc_feature (609)..(609): Xaa can be any naturally occurring amino acid
  unsure (1)..(609): unsure at all Xaa locations
RLPALPSAAHAHLLRHRRLVATPLRLPTTPTPLRQPAALPLRPCLRPPRAASVASPAPVPGDAPDNSRKFLGVDALTLKKIVPLGLMFFCILFNYTILRDTKDVLVVTAKGSSAEIIPFLKTWVNLPMAIGFMLLYSKLADVLSKEALFYTVIFPFIAFFGVFGYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRQNLGPGVDGWAISLKGMMSIVVVLGFVIAGIYWGVNKYVIDKTSLPVERKKKNKPKLSMGESLKVLVSSQYVRDLATLVVAYGISINLVEVTWKSKLKAQFPSPNEYSSFMGDFSTATGIATFTMMLLGRLILRKFGWGVAATITPAVLLVTGVGFFSLLLFGEPLTPLLATFGMTPLLAAVFVGALQNIFSKSAKYSLFDPCKEMAYIPLDEDMKVKGKAAIDVVCNPLGKSGGALIQQFMILSFGSLANSTPYLGGILLVIVIAWLGAVRSLDSQFSPLAKQDLEREQQLKAEVVETTAQVVGTGNGSLQENVASQSSTNGTVIKQSQEPEITAPEKSGKQSX

SEQ ID NO: 11427 - protein, 551 aa, Zea mays
  misc_feature (551)..(551): Xaa can be any naturally occurring amino acid
  unsure (1)..(551): unsure at all Xaa locations
MNSSRSLLSSPLFASSSPNFRSSASVSSSPSPSRTTAVPMIHDTSSSRASTACHYSPSLVAEEQLHGSKDTLTLKGEKALLELLLGMALDQHVDGRKLITQQEAEDSDFESYLREATSRVLYQPTFMYGASEFISSEEDDDDSISESSSASLAKPAGTLDLGKLTEEPQLDVPQPHRRSVDPNHSYDQVFIRSTRLLERRSKKRNGGHRALDNGVACSGVNSKRKDKFGRVLDPDEPFRLFLRDRETTEFLTAKEEKQMFSQIQDLMKLEEAQRNLQAQCGREPTVEEWAQAVGMSCRELQSCVRTGRRCREKMARSNFRLVIHVARKYEGCGLDIQDLVQDGCCGLMKTFEKFNPSKGCRFPTYAYWWIRQSIKKSIFKNSRLIRLPESVYALLRKVGKARMECIMDGEQPTNEVVARRAGITIEKLAKLRAKTRKVRSMQDRVWSDDGVTYQEITEDPNIEGPEVSVDRLMMRQQVRSFLAGILSPREKEIIEHRFGIHDGQPKTLHVIGDMYGLSKERIRQVQNKALDKLRNSISAQGFHVYFDLLTX

SEQ ID NO: 11428 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11429 - protein, 370 aa, Zea mays
  misc_feature (370)..(370): Xaa can be any naturally occurring amino acid
  unsure (1)..(370): unsure at all Xaa locations
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGPKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMGEADLAFIDNPKARKYIKSLPYAPGAPFTGMYPQAHPLAIDLLQKMLVFDPSKRISVTEALEHPYMSPLYDPSANPPAQVPIDLDIDENLGVDMIREMMWQEMIHYHPEVLTRISMX

SEQ ID NO: 11430 - protein, 191 aa, Zea mays
  misc_feature (191)..(191): Xaa can be any naturally occurring amino acid
  unsure (1)..(191): unsure at all Xaa locations
PAGIAYHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11431 - protein, 293 aa, Zea mays
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPPCP

SEQ ID NO: 11432 - protein, 493 aa, Zea mays
  misc_feature (493)..(493): Xaa can be any naturally occurring amino acid
  unsure (1)..(493): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIRTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSMX

SEQ ID NO: 11433 - protein, 291 aa, Zea mays
  misc_feature (291)..(291): Xaa can be any naturally occurring amino acid
  unsure (1)..(291): unsure at all Xaa locations
RGRPGPQHPQFPDHTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 11434 - protein, 419 aa, Zea mays
  misc_feature (419)..(419): Xaa can be any naturally occurring amino acid
  unsure (1)..(419): unsure at all Xaa locations
MATRVLPPALLSFILLLLLSLSARDTVAAGEDFPRDGRVIDLDDSNFEAALGAIDFLFVDFYAPWCGHCKRLAPELDEAAPVLSGLSEPIVVAKVNADKYRKLGSKYGVDGFPTLMLFIHGVPIEYTGSRKADQLVRNLKKFVSPDVSILESDSAIKNFVENAGISFPIFLGFGVNDSLIAEYGRKYKKRAWFAVAKDFSEDIMVAYEFDKVPALVAIHPKYKEQSLFYGPFEENFLEDFVRQSLLPLVVPINTETLKMLNDDQRKVVLTILEDDSDENSTQLVKILRSAANANRDLVFGYVGIKQWDGFVETFDVSKSSQLPKLLVWDRDEEYELVDGSERLEEGDQASQISQFLEGYRAGRTTKKKITGPSFMGFLNSLVSLNSLYILIFVIALLFVMVYFAGQDDTPQPRRIHEEX

SEQ ID NO: 11435 - protein, 262 aa, Zea mays
  misc_feature (262)..(262): Xaa can be any naturally occurring amino acid
  unsure (1)..(262): unsure at all Xaa locations
MSGWRVEISGGFAFIYMEDERDAEDAISRLDGIDFGRKGRRIKVEWTKEDRTADRRGNSRRSPTNAKPTKTLFVINFDPINTRIRDLERHFDKYGRVANVRIKKNFAFIQFEAQEDATRALEGANGSHFMDRVISVEYALRDDDEKGERATNGYSPDRRGRERSPGARRSPSPYGRGRERGSPDYGRGKERGSPDYGRGGRSPDGRGGRPAGGGGGGRGDHARGGGRRRSPDYYDRERREASPGYDRPPSCSPGTGRDARDX

SEQ ID NO: 11436 - protein, 586 aa, Zea mays
  misc_feature (586)..(586): Xaa can be any naturally occurring amino acid
  unsure (1)..(586): unsure at all Xaa locations
KKLDATSFSFPPDFLFFFSWIGLTLLKTSAAAAAVAVAAPAFSMNTVALLSLAPQLLIKPSLTCFSRKGVGRYGGIKVYAVLRDDGAEFAKNNNLEALFHVDDPGPRVPIKKGRFLDVNEALEVVRFDIQYCDWRARHDLLTIMVLHNKVVEVLNPLAREFKSIGTLRKELAELQQELAKAHNQVHLSETRVSSALDKLAHMETLVNDRLLPPDGASSTSTAQPTSLVPSTSSTARVRAKKPPRRGLNVSGPVKPYNPSLKNFWYPVAFSSDLKDDTMVPIACFEEQWVIFRGKDGRPGCVQNTCAHRACPLHLGSVNEGRIQCPYHGWEYSTDGKCEKMPSTKMLNVRIQSLPCFEQEGMVWIWPGDDPPKATIPSLLPPSGFTVHAEIVMELPVEHGLLLDNLLDLAHAPFTHTSTFAKGWSVPSLVKFLTPASGLQGYWDPYPIDMEFRPPCMVLSTIGISKPGKLEGKSTQQCSTHLHQLHVCLPSSRNKTRLLYRMSLDFAPWLKHVPLMHLLWSHFAEKVLNEDLRLVLGQQERMINGANVWNWPVSYDKLGVRYRLWRDTVERGSERLPFSNQAESGSX

SEQ ID NO: 11437 - protein, 656 aa, Zea mays
  misc_feature (656)..(656): Xaa can be any naturally occurring amino acid
  unsure (1)..(656): unsure at all Xaa locations
TPWGTLEVCRVNQNPKTHLLLSFPLPFPARGATCAAATMPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTGEVMEDKDEKSKAEEVIKEEKVVKNKASSKADESELRLAQLQHQLPTNEPGALMNLVEESTADDADDDDTKDCKGLFKNLKFYLSREVPRESLFFIIPAFGGTVSWEGEGAPFKEIDEDITHQIVDRPTQSHVFLSRDYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRHX

SEQ ID NO: 11438 - protein, 195 aa, Zea mays
  misc_feature (195)..(195): Xaa can be any naturally occurring amino acid
  unsure (1)..(195): unsure at all Xaa locations
PRGRPGAYHPRLYISSLSAPPPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11439 - protein, 389 aa, Zea mays; identical to SEQ ID NO: 10019
  misc_feature (389)..(389): Xaa can be any naturally occurring amino acid
  unsure (1)..(389): unsure at all Xaa locations

SEQ ID NO: 11440 - protein, 185 aa, Zea mays
  misc_feature (185)..(185): Xaa can be any naturally occurring amino acid
  unsure (1)..(185): unsure at all Xaa locations
MGGCCCCSSRTSEAVRARAPVDIYHQQNLEEQEPLSSIFDGSSPASAIVAVDTNLDTSTPDTYRAPPAPLPYDVILAVPNNPGFGNSVGLEKPDTKSKTDDQQESINDQESLKVDESCKKSVTEDKADEEDVCPICLEEYDEENPRSITKCEHHFHLCCILEWMERKDTCPVCDQITLVDEMFEX

SEQ ID NO: 11441 - protein, 271 aa, Zea mays; identical to SEQ ID NO: 10016
  misc_feature (271)..(271): Xaa can be any naturally occurring amino acid
  unsure (1)..(271): unsure at all Xaa locations

SEQ ID NO: 11442 - protein, 192 aa, Zea mays
  misc_feature (192)..(192): Xaa can be any naturally occurring amino acid
  unsure (1)..(192): unsure at all Xaa locations
RGAYHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11443 - protein, 285 aa, Zea mays
  misc_feature (285)..(285): Xaa can be any naturally occurring amino acid
  unsure (1)..(285): unsure at all Xaa locations
VAGAGDSSSTDSPGGSLRRAHRDRGSTMAANFWTSSHCKQLLDPEDVDLVPAADRERGITPEEFRLIKIHMSFHIWRLAQQVKVRQRVVATAIAYFRRVYTRKSMSDYDPRLVAPTCLYLASKVEESTVQARLLVFYIKKMCGSDDKYRFEIKDILEMEMKLLEALDYYLVVFHPYRPLLQLLQDAGITDLTQFAWGLVNDTYKMDLILIYPPYMIALACIYIASVLKDKDTTAWFEELRVDMNIVKNISMEILDFYDTYKIDPQRGIPEDKISPVMNKLPAKAX

SEQ ID NO: 11444 - protein, 261 aa, Zea mays
  misc_feature (261)..(261): Xaa can be any naturally occurring amino acid
  unsure (1)..(261): unsure at all Xaa locations
MFPPGLIHHRPDAPVPGDGATRSGPGGPSLVLTADPKPRLRWTADLHERFVDAVAQLGGPEKATPKTILRTMGVKGLTLFHLKSHLQKYRLGKQSGKEGSEQSKDASYLLDAQSGMSVSPRVPAQDMKESQEVKEALRAQMEVQRRLHEQVEVQKRVQIRMEAFQKYIDSILESPCKMVTEQFASSGFSISDPDLPEISPGGVVMCGGPTDTLSSSVFNQLSVSSIGSHSPGGKPSPSPSGMECPPLLLHKSHELKRRSSX

SEQ ID NO: 11445 - protein, 252 aa, Zea mays
  misc_feature (252)..(252): Xaa can be any naturally occurring amino acid
  unsure (1)..(252): unsure at all Xaa locations
MGRGPVQLRRIENKINRQVTFSKRRNGLLKKAHEISVLCDAEVALIVFSTKGKLYEYSSHSSMEGILERYQRYSFEERAVLNPSIEDQANWGDEYVRLKSKLDALQKSQRQLLGEQLSSLTIKELQQLEQQLDSSLKHIRSRKNQLMFDSISALQKKEKALTDQNGVLQKFMEAEKEKNKALMNAQLREQQNGASTSSPSLSPPIVPDSMPTLNIGPCQHRGAAESESEPSPAPAQANRGNLPPWMLRTVKX

SEQ ID NO: 11446 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11447 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11448 - protein, 193 aa, Zea mays
  misc_feature (193)..(193): Xaa can be any naturally occurring amino acid
  unsure (1)..(193): unsure at all Xaa locations
GKLIAYHPRLYISSLSAPPPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVARIKEGFESGKDLVVTVQSAMGEEQICALKDVGPKX

SEQ ID NO: 11449 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 11450 - protein, 287 aa, Zea mays
  misc_feature (287)..(287): Xaa can be any naturally occurring amino acid
  unsure (1)..(287): unsure at all Xaa locations
PGQHPQFPDHTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLVMQLLRDNLTLWTSDLTEDGADEGKDAPKGDAGEGQX

SEQ ID NO: 11451 - protein, 348 aa, Zea mays
  misc_feature (348)..(348): Xaa can be any naturally occurring amino acid
  unsure (1)..(348): unsure at all Xaa locations
MADNSIEQALIENPPNALKWKPSERAKRFRRCRSTPSDPTDQKPAENGSVLKAKELFKEKRPSFMLVGLLLFAYLLVGVIIFYLFMDQLSGKTTDRVLDALYFVIVTMTSVGYGDLFPNSDTTKLLACAFVFTGMAIIALFISKAADYLVEKQEVLFFKALHMNMKGSEAKMLGAMETNRIKYKFYTVALLLAMVIVAGTVFLWKVEKLSLVDSFYCVCATITTLGYGDKSFSSKLGRVFAVFWITTSTLIMAQFFMYLAELYTERRQKILTKWVINRRITTMDLEAADIDDDRQVGAAEFVLYKLKELGKISQEEISCFPEEFDKLDVDQSGTLSTYDLTLGQTSQX

SEQ ID NO: 11452 - protein, 193 aa, Zea mays
  misc_feature (193)..(193): Xaa can be any naturally occurring amino acid
  unsure (1)..(193): unsure at all Xaa locations
GKLIAYHPRLYISSLSAPPPPPPPDPSKTGIAMSDSEEHHFESRADAGASKTYPQQAGTVRKNGFIVIENRPCKVVEVSTSKTGKHGHAKCHFVAIDIFNGKKLEDIVPSSHNCDIPHVNRTEYQLIDISEDGFVSLLTSDGNTEDDLRLPTDETLVAQIKEGFESGKDLVMTVQSAMGEEQICALKDVGPKX

SEQ ID NO: 11453 - protein, 218 aa, Zea mays
  misc_feature (218)..(218): Xaa can be any naturally occurring amino acid
  unsure (1)..(218): unsure at all Xaa locations
LEAGRDPQYIPTLRLLSGAARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11454 - protein, 420 aa, Zea mays; identical to SEQ ID NO: 11333
  misc_feature (420)..(420): Xaa can be any naturally occurring amino acid
  unsure (1)..(420): unsure at all Xaa locations

SEQ ID NO: 11455 - protein, 380 aa, Zea mays
  misc_feature (380)..(380): Xaa can be any naturally occurring amino acid
  unsure (1)..(380): unsure at all Xaa locations
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMEDX

SEQ ID NO: 11456 - protein, 171 aa, Zea mays
  misc_feature (171)..(171): Xaa can be any naturally occurring amino acid
  unsure (1)..(171): unsure at all Xaa locations
GLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11457 - protein, 574 aa, Zea mays
  misc_feature (574)..(574): Xaa can be any naturally occurring amino acid
  unsure (1)..(574): unsure at all Xaa locations
MAYFPDEVVGYILGYVTSHQDRNAVSLVCQAWYDIERHGRHSVLVRNCYAVCPERVHMRFPNMRALSLKGKPHFAEFNLVPAGWGATANPWVDACARACPGLEELRLKFMVVTDECLKLLSLSFTNFKSLVLVCCEGFSTTGLANIATNCRFLKELDLQKSCVKHQDHQWINCFPKSSTSLECLNFSCLTGEVNAVALEELVARSPNLKSLRLNLAVPFDVLSRILSRTPKLEDLGTGSFLQGNDPAAYASLCRALENCTSLKSISGFWDAPGFYVQGILSNCKIRNLTCLNLSYATLIQSTQLIGIIRHCKKLHVLWVLDHIGDEGLKAVSFSCPDLQELRVYPSVVAPRGTVTEEGLVALSSCRKLQHVLFSCVRMTNTALMTIARYCPRLTSFRLCIRKPRSADAVTGQPLDEGFGAIVRSCRGLRRLAMSGLLTDSVFLYIGMYAEKLEMLSVTFAGDTDDGMVYVLNGCRNLKKLVIKESPFGDAALLAGAHRYESMRSLWMSSCQITLGGCRALAATMPNINVEVIGGASFGAMDGGVSDARKVDMLYLYRTLAGPRCDTPGFVSILX

SEQ ID NO: 11458 - protein, 658 aa, Zea mays
  misc_feature (658)..(658): Xaa can be any naturally occurring amino acid
  unsure (1)..(658): unsure at all Xaa locations
GEKVPPSTLPRPELEPLKISLSYLSPSSSRPPHPGSTPCKSAGRSKRGRGGKQIGWRQPVAGSAGTMGGEAEGGERRLGRVLSFGIPDTALGLVMGYVEDPWDRDAISLVCRHWCRVDALSRKHVTVAMAYSTTPERLFGRFPCLESLKLKAKPRAAMFNLISDDWGGSASPWIRQLSATFHSLKKLHLRRMIVSNDDINTLVRAKAHMLVSLKLDRCSGFSTPSIALIARSCRKLETLFLEESMIDEKENDEWIRELATSNSVLETLNFFQTDLRASPEYLTLLVRNCQRLKTLKISECFMPDLVSLFRTAQTLQEFAGGSFEDQGQPVAGRNYENYYFPPLLHRLSLLYMGTNEMQILFPYAAALKKLDLQFTFLSTEDHCQIVQRCPNLETLEVRDVIGDRGLQVVAETCKKLQRLRVERGDDDQGGLEDEQGRISQVGMMAIAQGCPELTYWAIYVSDITNAALEAVGTCSRNLNDFRLVLLDREAHITELPLDNGVRALLRGCTKLRRFAFYVRPGVLSDVGLGYVGEFSKSIRYMLLGNVGESDNGIIQLSKGCPSLQKLELRGCLFSEHALAMAALELKSLRYLWVQGFRSSPTGTDLMAMVRPFWNIEYILPDQDEPCPEYKKQILAYYSLAGRRTDCPPSVTPLYPAVX

SEQ ID NO: 11459 - protein, 118 aa, Zea mays; identical to SEQ ID NO: 10001

SEQ ID NO: 11460 - protein, 355 aa, Zea mays
  misc_feature (355)..(355): Xaa can be any naturally occurring amino acid
  unsure (1)..(355): unsure at all Xaa locations
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCNAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLTFGYVLLHDPFSWRNILGILIAVVGMVLYSYFCTVETQHKNTEVSPQQVKESEAAPLISDSLSKVENGGGVVDDEPLKVPMWSSKYSREX

SEQ ID NO: 11461 - protein, 391 aa, Zea mays
  misc_feature (391)..(391): Xaa can be any naturally occurring amino acid
  unsure (1)..(391): unsure at all Xaa locations
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKIFKLIDESMRRSREGTX

SEQ ID NO: 11462 - protein, 271 aa, Zea mays
  misc_feature (271)..(271): Xaa can be any naturally occurring amino acid
  unsure (1)..(271): unsure at all Xaa locations
MWGFASNAWAAGLEKRSSPSRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHPNHGGFPLLNTGRVQASLRKSLSFLVHLTAKFPLVFVFLLIVLYAIPASAAVLLLYILITVLFALPSFLILYFAYPSLDWLVREIFAX

SEQ ID NO: 11463 - protein, 515 aa, Zea mays
  misc_feature (515)..(515): Xaa can be any naturally occurring amino acid
  unsure (1)..(515): unsure at all Xaa locations
MASPRGRMSFPLRSFLMICLMAQLGASNVVLMANNTTLSFDDVEAIFTPAVKGSGVNGVLYAVEPMDACSPLRTKAIGGSVSTFALVIRGGCHFDDKVRNAQNAGFKAAVVYDTEDNGILVSMAGSSSGVHIYAVFVSKASGEELKKYSGQTDAELWIIPTYANSAWSIMAISFISLLVMSAILAACFFARRHQIRRDRARLPQTREFHGMNSRLVKAMPSLIFTKVQEDDCTSATCAICLEDYSAGEKIRVLPCRHKFHAACVDLWLTSWRTFCPVCKRDANAGTPEPPVSESTPLLSSSAIRLPEPTASVSFWSTVAAAAAASPPRPISRHPSPSRSISRKHSVSGSSIPGTPIPRFHASSSSPTCTSGSSLDLANMPSSPWPRASHLASAHSSCGGRLSPPIHIRNTSAAHVSRSAYGSPSRYVGSSHMSRGSPSCYYLGSSSGQQHPYLRHCTLSGTSLFTMVPQSPQQNQLQHGGDSEKDLSAAAPFRQLYYLQHCPDSGTSSQSLPGCX

SEQ ID NO: 11464 - protein, 251 aa, Zea mays
  misc_feature (251)..(251): Xaa can be any naturally occurring amino acid
  unsure (1)..(251): unsure at all Xaa locations
RPAGALHFHPLPSPVRIRVGPPHPSSTSLLGPPYPSCLSCFFSNGALATSKSIRKKVNQGKRVRDREKLQKKKKHVEKERRPSPGNTIRSRVERKRKTTSPSAAEAKQPLAAARPRRLLPRSSPATSTPPDERGFQDAEGTSGAKLLIQSLGKAYAATPTNLKIIDLYVGFAVATALIQVAYMGLVGSFPFNSFLSGVLSCIGTAVLAVCLRIQVNKDNKEFKDLPPERAFADFVLCNLVLHLVIMNFLGX

SEQ ID NO: 11465 - protein, 237 aa, Zea mays
  misc_feature (237)..(237): Xaa can be any naturally occurring amino acid
  unsure (1)..(237): unsure at all Xaa locations
PGPQNPSPIALLPRAFNFSKPHLAAEAERAEQNTTSAAFPCLSAGYYTRRRSADPVRVKRSGGSDWLLPSLHLMLVHQQNLEEQEPLSSIFDGSSPASAIVAVDTNLDTSTPDTYRAPPAPLPYDVILAVPNNPGFGNSVGLEKPDTKSKTDDQQESINDQESLEVDESCKKSVTEDKADEEDVCPICLEEYDEENPRSITKCEHHFHLCCILEWMERKDTCPVCDQITLVDEMFEX

SEQ ID NO: 11466 - protein, 224 aa, Zea mays
  misc_feature (224)..(224): Xaa can be any naturally occurring amino acid
  unsure (1)..(224): unsure at all Xaa locations
RGRPGTIAPTRSASSSPASDPHSPPLLPPPPAPAPFSPLLASPRARFYKGFGGGARSLAMADDGGSHEGSGGGGGVREQDRFPPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGETX

SEQ ID NO: 11467 - protein, 317 aa, Zea mays
  misc_feature (317)..(317): Xaa can be any naturally occurring amino acid
  unsure (1)..(317): unsure at all Xaa locations
REPQEATSGSRRGSTRANPAASSPRTPSHPSRSTRRAGPPDMAPAAPYGGAESQRQADLLKQEGNAFFRKERLSAAIDAYTGAITLCPNVAVYWTNRALCYRKRNEWTRVEEDCGTAIQLDSQSVKAHYMLGLSLVNSQRLSEGIKSLEKSLELGRGAHPASYMVEEIWQELSKAKYIEWESLSRDRTCQLQKLKVACKEALTSYNSLDNPAAGAPVEQLNELEEVFKKAAKTDTPAEVPDHLCCKITLDIFRDPVITPSGITYERAVLLDHLQTVGRFDPVTREALEPHQLVPNLAIKEAVHAFLSEHGWAYKIRX

SEQ ID NO: 11468 - protein, 177 aa, Zea mays
  misc_feature (177)..(177): Xaa can be any naturally occurring amino acid
  unsure (1)..(177): unsure at all Xaa locations
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11469 - protein, 193 aa, Zea mays
  misc_feature (193)..(193): Xaa can be any naturally occurring amino acid
  unsure (1)..(193): unsure at all Xaa locations
LEAGRDLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11470 - protein, 191 aa, Zea mays
  misc_feature (191)..(191): Xaa can be any naturally occurring amino acid
  unsure (1)..(191): unsure at all Xaa locations
RELITYHPHPHLSPSPCSSASFLIQPSQGSPSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11471 - protein, 260 aa, Zea mays
  misc_feature (260)..(260): Xaa can be any naturally occurring amino acid
  unsure (1)..(260): unsure at all Xaa locations
MDRKRIKDALEKHLERSSPFTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPSX

SEQ ID NO: 11472 - protein, 276 aa, Zea mays
  misc_feature (276)..(276): Xaa can be any naturally occurring amino acid
  unsure (1)..(276): unsure at all Xaa locations
REKKKSLSHLPRCPRPQRLASAALPLSRDPRDRNRGAPSPSSKMAPSLLGGFTKSLAMTVLSEIGDKTFFAAAILAMRHPRKLVLAGCLTALIVMTALSASLGWVAPNLISRKWTHHLTTLLFFLFGIWSLWEGFKEDGDSEELAEVEAELDAAFKSNKGESKNKFKANDDMKKQQRPFLMQFFSPIFLKAFSITFFGEWGDKSQIATIGLAADENPFGVVLGGIIAQALCTTAAVLGGKSLASQISEKMVELSSEVLFLLFGIMSLLSGPEGELX

SEQ ID NO: 11473 - protein, 127 aa, Zea mays
  misc_feature (127)..(127): Xaa can be any naturally occurring amino acid
  unsure (1)..(127): unsure at all Xaa locations
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLPKKAAEKAASGGSKEPKSPKKGAKSPKKAX

SEQ ID NO: 11474 - protein, 195 aa, Zea mays
  misc_feature (195)..(195): Xaa can be any naturally occurring amino acid
  unsure (1)..(195): unsure at all Xaa locations
GIEAGRDHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11475 - protein, 187 aa, Zea mays
  misc_feature (187)..(187): Xaa can be any naturally occurring amino acid
  unsure (1)..(187): unsure at all Xaa locations
PDHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11476 - protein, 141 aa, Zea mays
  misc_feature (141)..(141): Xaa can be any naturally occurring amino acid
  unsure (1)..(141): unsure at all Xaa locations
RGRPGKKKKKKSNPSVPNLPYTRKIPSSLVRVREAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGX

SEQ ID NO: 11477 - protein, 243 aa, Zea mays
  misc_feature (243)..(243): Xaa can be any naturally occurring amino acid
  unsure (1)..(243): unsure at all Xaa locations
MASLFKDPSKLSAYRDRRFKGTQEECEAALLASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVLRELEAQRELVDYGGSFQPNAPPPYERSERKRGHGDSHRNDRGDYQQKRYRNDDRSAPEESKRAPDSDPAEKNPRFREKGDSDEEEDDYDGKRRRX

SEQ ID NO: 11478 - protein, 189 aa, Zea mays
  misc_feature (189)..(189): Xaa can be any naturally occurring amino acid
  unsure (1)..(189): unsure at all Xaa locations
GIAYRLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11479 - protein, 193 aa, Zea mays
  misc_feature (193)..(193): Xaa can be any naturally occurring amino acid
  unsure (1)..(193): unsure at all Xaa locations
SRPAGIAYHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11480 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11481 - protein, 289 aa, Zea mays; identical to SEQ ID NO: 10780
  misc_feature (289)..(289): Xaa can be any naturally occurring amino acid
  unsure (1)..(289): unsure at all Xaa locations

SEQ ID NO: 11482 - protein, 164 aa, Zea mays; identical to SEQ ID NO: 11266
  misc_feature (164)..(164): Xaa can be any naturally occurring amino acid
  unsure (1)..(164): unsure at all Xaa locations

SEQ ID NO: 11483 - protein, 599 aa, Zea mays; identical to SEQ ID NO: 11270
  misc_feature (599)..(599): Xaa can be any naturally occurring amino acid
  unsure (1)..(599): unsure at all Xaa locations

SEQ ID NO: 11484 - protein, 599 aa, Zea mays; identical to SEQ ID NO: 11270
  misc_feature (599)..(599): Xaa can be any naturally occurring amino acid
  unsure (1)..(599): unsure at all Xaa locations

SEQ ID NO: 11485 - protein, 239 aa, Zea mays
  misc_feature (239)..(239): Xaa can be any naturally occurring amino acid
  unsure (1)..(239): unsure at all Xaa locations
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQQGQAVELEPEQQLDPRAQPAHDAEETAAEPPPAASNGTADGGNKRKAAAMEEEGMLAVMTVAAPESSTKPRLSTTSNSLAVETX

SEQ ID NO: 11486 - protein, 140 aa, Zea mays; identical to SEQ ID NO: 9977

SEQ ID NO: 11487 - protein, 140 aa, Zea mays; identical to SEQ ID NO: 9977

SEQ ID NO: 11488 - protein, 168 aa, Zea mays
  misc_feature (168)..(168): Xaa can be any naturally occurring amino acid
  unsure (1)..(168): unsure at all Xaa locations
PGFGFVGGRIEMAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGYGGGNRGGGYGNSDGNWRNX

SEQ ID NO: 11489 - protein, 140 aa, Zea mays; identical to SEQ ID NO: 9977

SEQ ID NO: 11490 - protein, 402 aa, Zea mays
VMSNRDEVSVVVKCLRLGAAEYLVKPLRTNELLNLWTHVWRRRRMLGLPEKNFFNDNFELVLSEPSDANTNSATLLSDETDDRPKENTNQETGTSNQLEYESNPSVAERDQRDKIGAPGSALDASQSSTPGRMFSRPIKTNLKVAESSAFLAYVKSSTPATSSFDSGLQRGDSRLDSLDNHGNCSSATDRSDTGTDVNIRNKEAFEMPVQYPMVCFSSSSMHMERSNEGHNDTSGTPPAYHFPFYYPGMVEHNMALSSVQNFQANINSAQAHTPPAMLHQYNVFSQCHSLPMISPFQFNTSGMSMHSSHLPTQNVWSSASSTPTPDETCNRSERRAAALAKFRQKRKERCFDKKVRYVNRKKLAETRLRVRGQFVRHASNMDIISTGDDISEDEDDDPTSRE

SEQ ID NO: 11491 - protein, 168 aa, Zea mays; identical to SEQ ID NO: 10685

SEQ ID NO: 11492 - protein, 140 aa, Zea mays; identical to SEQ ID NO: 9977

SEQ ID NO: 11493 - protein, 157 aa, Zea mays; identical to SEQ ID NO: 11172

SEQ ID NO: 11494 - protein, 158 aa, Zea mays; identical to SEQ ID NO: 9989
  misc_feature (158)..(158): Xaa can be any naturally occurring amino acid
  unsure (1)..(158): unsure at all Xaa locations

SEQ ID NO: 11495 - protein, 168 aa, Zea mays; identical to SEQ ID NO: 11488
  misc_feature (168)..(168): Xaa can be any naturally occurring amino acid
  unsure (1)..(168): unsure at all Xaa locations

SEQ ID NO: 11496 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11497 - protein, 304 aa, Zea mays; identical to SEQ ID NO: 9957
  misc_feature (304)..(304): Xaa can be any naturally occurring amino acid
  unsure (1)..(304): unsure at all Xaa locations

SEQ ID NO: 11498 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11499 - protein, 360 aa, Zea mays
  misc_feature (2)..(2): Xaa can be any naturally occurring amino acid
  misc_feature (6)..(6): Xaa can be any naturally occurring amino acid
  misc_feature (25)..(25): Xaa can be any naturally occurring amino acid
  misc_feature (183)..(183): Xaa can be any naturally occurring amino acid
  unsure (1)..(360): unsure at all Xaa locations
RXSRCXRLTRWGSSSSLTGWCWRRXRGAAPTATCRSHTPPCTTRNAPPGVACSSRRPRGCRPPRRGSRSLLASGRRSRSRRGSPSSTPSTARAPSSSARSGMWAGSPPTSSSPTATRLSRARTSRSPPTPSPERRTRSRAGCGPTRSPGSSTTSGGPHGTRSRLVSTPSRSTARTGTSWSSSXRTAATTARTSTAAAWRTGAVSPWRSWTPSSARWARAASASGCRPSSTSWTAWTRTRWRSATTWCSSSTGIAACSTATWWSPALPPTGAGRSLTGSCRSERRFMERSSPPVGTIGRKATRWWQKGMLTSSRMGSCSWLTRTCLGGSSWMWHSTNTTAPPSTRKILLLATQITLSLKKK

SEQ ID NO: 11500 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11501 - protein, 372 aa, Zea mays
  misc_feature (372)..(372): Xaa can be any naturally occurring amino acid
  unsure (1)..(372): unsure at all Xaa locations
TRYKMSTLSDPSKEDTSPEGSGTTQRNGAWSNTLNTLLQQASVYGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVTAYTWAVAYLASMSIDFVYIKHVVMTIGLNTWGLVLYNNLEALMLFPLELLIMGEFDQMKVDSSKVSNWLSFDVVLPVALSCLFGLSISFFGFSCRRAISATGFTVLGIVNKLLTVVINLLIWDKHASFVGTIGLLICMSGGVLYQQSTMKPKAPKVEPKEENDNDEEQQKLLQMQGVQESNPTQKX

SEQ ID NO: 11502 - protein, 141 aa, Zea mays; identical to SEQ ID NO: 4666

SEQ ID NO: 11503 - protein, 659 aa, Zea mays; identical to SEQ ID NO: 10494

SEQ ID NO: 11504 - protein, 137 aa, Zea mays
HHQEEAHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGGLLGKIMDKIPGYHKSSAEEADHKADAAGEHRTSS

SEQ ID NO: 11505 - protein, 344 aa, Zea mays
  misc_feature (344)..(344): Xaa can be any naturally occurring amino acid
  unsure (1)..(344): unsure at all Xaa locations
EMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 11506 - protein, 181 aa, Zea mays
  misc_feature (181)..(181): Xaa can be any naturally occurring amino acid
  unsure (1)..(181): unsure at all Xaa locations
PLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11507 - protein, 117 aa, Zea mays; identical to SEQ ID NO: 11359

SEQ ID NO: 11508 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11509 - protein, 878 aa, Zea mays
  misc_feature (878)..(878): Xaa can be any naturally occurring amino acid
  unsure (1)..(878): unsure at all Xaa locations
DQGTGREAAPASVVPIHGNLTQLIRQIKSRRLLYIKEKLEANRKTLQRHSCALFDVAAAAEVASRGSDGGNALSQRAAEGQFRLAGSDLAHGIGERDVVYMQEENLASGTLVLSSSGAAAQRTVVRFVKLPLVERIPPYTTWIFLDKNQRMADDQSVVGRRRIYYDPIGNEALICSDSDEEIPEPEEEKHFFTEGEDQLIWRATQEHGLNREVVNVLCQFIDSTPSEIEERSEVLFEKNEKNSGSSDKIERQLSLDKTMDAVLDSFDNLFCRRCLVFDCRLHGCSQNLVFPSEKQPYSFEPDENKKPCGRQCYLRWREGFQEIHDVGLSGCATYNMESGTVSHKVDVSIMSESEDSNREKGNIRSMTLVGTSGSKIISSVSAEESTTPPSADTSETENASSDMPPSSLRKYKISKRGPRYRERSPGKRQKVFTYDISFASNILNKLSIPEIRDTRLESREPGGDKLQILDESTKKTSSKDICGESPITTTENVGRESKKVSSTKNFLEHTLSCWSALERDLYLKGIEIFGKNSCLIARNLLSGMKTCMEVANYMYNNGAAMAKRPLLNKSISGDFAETEQDYMEQDMVARTRIYRRRGRNRKLKYTWKSAGHPTVRKRIGDGKQWYTQYNPCVCQQMCGKDCPCVENGTCCEKYCGCSKSCKNKFRGCHCAKSQCRSRQCPCFAASRECDPDVCRNCWVSCGDGSLGEPPARGDGYQCGNMKLLLKQQQRILLGRSDVAGWGAFIKNPVNKNDYLGEYTGELISHKEADKRGKIYDRANSSFLFDLNDQYVLDAYRKGDKLKFANHSSNPNCYAKVMLVAGDHRVGIYAKEHIEASEELFYDYRYGPDQAPAWARRPEGSKKDEASVSHHRAHKVARX

SEQ ID NO: 11510 - protein, 378 aa, Zea mays; identical to SEQ ID NO: 10138
  misc_feature (378)..(378): Xaa can be any naturally occurring amino acid
  unsure (1)..(378): unsure at all Xaa locations

SEQ ID NO: 11511 - protein, 343 aa, Zea mays
  misc_feature (343)..(343): Xaa can be any naturally occurring amino acid
  unsure (1)..(343): unsure at all Xaa locations
MKFGATYEEYLRAERDKFLGQCSHVEYKRLKKVLKKCRVGRSLQADGTNGDEQQEGRDESSNICECNSCTLCDEMFFTELNKEASEIAGCFRSRVQRLLHLHVPSGLQRCIWRFRQCFIDDQQIMVQEGRMLLNYVTMNAIAIRKILKKYDKIHGSVSGRDFKSKMQTEHIELLQSPWLIELAAFHLNCDDSDADEPRAGEFFKNGFFKNFSCDLSGAQPLLTMTISETLKYEYSLTCPICLDTLFNPYALSCGHLFCKACACGAASVYIFQGVKSAPPEAKCPVCRAVGVFDRAVRMTELELLLKRRDKDYFLQRLREERSVMVKQAKEYWDSQAMLSMGIX

SEQ ID NO: 11512 - protein, 403 aa, Zea mays
  misc_feature (403)..(403): Xaa can be any naturally occurring amino acid
  unsure (1)..(403): unsure at all Xaa locations
RKIKKKRSESEAAVSRLRLRLRRFGLLLQTPGMAAGAGGGELEALEGVRSIVLKPSESLDESRFTRIAGADFNDPAVGLEGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNPKX

SEQ ID NO: 11513 - protein, 301 aa, Zea mays
RPRRQSTVRAVAAVAPAAPAAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPIVRWGLADFAAAVKEAGVHGLIVPDLPYGNSCALTLRTEAIKNNLELVLLTTPSTPADRMEEITRASRGFVYLASVNGVTGPRANVNTRVQSLIQEVKQVTDIPVAVGFGISKPEHVKQIAEWGADGVIIGSAMVRQLGEAASPKEGLKRLEKYARIMKNALPCQ

SEQ ID NO: 11514 - protein, 248 aa, Zea mays
VFARWYRAPELLFGSKHYGSGVDIWAAGCIFAELLTRRAFLQGSSDIDQLGKIFAALGTPKSSQWPDMVYLPDYVEYQYVAAPPLRTLLPMASDDALDLLSRMLTYDPKARISAQQALEHRYFSSLPAPTRPSQLLRSRWKGDQGNNKMPDLNLQHGPLVLSPPRKLRRVIAHEWMEGMHRADKVDEHPSGMRHTDDMPSQKSSRIPMSVDVGALFGTRPAPRPTLNSADKSRLKRKLDMDPEFGFAE

SEQ ID NO: 11515 - protein, 568 aa, Zea mays
  misc_feature (2)..(2): Xaa can be any naturally occurring amino acid
  misc_feature (63)..(63): Xaa can be any naturally occurring amino acid
  misc_feature (69)..(69): Xaa can be any naturally occurring amino acid
  misc_feature (80)..(80): Xaa can be any naturally occurring amino acid
  misc_feature (91)..(91): Xaa can be any naturally occurring amino acid
  misc_feature (209)..(209): Xaa can be any naturally occurring amino acid
  misc_feature (235)..(235): Xaa can be any naturally occurring amino acid
  misc_feature (245)..(245): Xaa can be any naturally occurring amino acid
  misc_feature (261)..(261): Xaa can be any naturally occurring amino acid
  misc_feature (285)..(285): Xaa can be any naturally occurring amino acid
  misc_feature (301)..(301): Xaa can be any naturally occurring amino acid
  misc_feature (337)..(337): Xaa can be any naturally occurring amino acid
  misc_feature (344)..(344): Xaa can be any naturally occurring amino acid
  misc_feature (377)..(378): Xaa can be any naturally occurring amino acid
  misc_feature (403)..(403): Xaa can be any naturally occurring amino acid
  misc_feature (440)..(440): Xaa can be any naturally occurring amino acid
  misc_feature (488)..(488): Xaa can be any naturally occurring amino acid
  misc_feature (493)..(493): Xaa can be any naturally occurring amino acid
  misc_feature (508)..(508): Xaa can be any naturally occurring amino acid
  misc_feature (527)..(527): Xaa can be any naturally occurring amino acid
  unsure (1)..(568): unsure at all Xaa locations
YXKTSLHVFIPPRRFRAIKQLFLPKISNPFTRSPCSIAFHDLKYTSCLHKFSLTNSSFLELSXPSVAEXRLFASSVESLXASAKAELFPIXGVLFFLELLVLGELCCEDTINSLFPFRVSDLSFMSLAKRYPLTKLESDDAISLCPFFTLIRILSAIRLLVIFLIPPFGPILTFEGLGECCGDLLLIGCTSESLLSEITLAVEELSLCXDLVFLPLEPFFFLFEPGWFITLSDEXVGSSTSKSMXSAPAAASGSDASLWQXIPQGTLSSTPLQAGCFSVGNTKSXEHPCSLQSNTYQHHQXAEMSISTQVLAFMSSAARSMCRASVCSTASDMPHSXTVIRIMXSSECLNSFFSSSSSMASSSLSLQIRASPQLVSXXILRRPSTDWSSVILWFLSKNIHVVXGGSFGTSGSLIGLIIAFLGPRFPPNITLDEEKGLSSXKVPPSLSTGIISRLCRVHSASSCLFVSKFDAESVPFDVLICLFFDKLXVLCVXLLILVLFSPILFLMXVKRSAVILFFNESITDKTXREAAFSSPARTAELLVTWAALLDGRDRPAEAEADADDATTA

SEQ ID NO: 11516 - protein, 154 aa, Zea mays
AGAKVVKKAAAGRRGGGGPKKKPVSRSVKAGLQFPVGRIGRYLKQGRYSQRVGTGAPVYLAAVLEYLAAGLLELAGNAARDNKKNRIIPRHVLLAIRNDEELGKLLAGVTIAHGGVLPNINPVLLPKKTAVAAAKEGKEKKSPKKAAAAKSPKK

SEQ ID NO: 11517 - protein, 142 aa, Zea mays; identical to SEQ ID NO: 5815

SEQ ID NO: 11518 - protein, 180 aa, Zea mays
  misc_feature (180)..(180): Xaa can be any naturally occurring amino acid
  unsure (1)..(180): unsure at all Xaa locations
MSRHPITKWAQRSDRVFLTIELPDAKDVKLNLKPEGHFNFSAKGSDDLPYEFDLELFDAVNVEESKAAVAPRTICYLIKKAESKWWPRLLKKEGKAPVFLKVDWDKWQDEDDEDVGFNDFSDMDFSKLDMGGADDDDFEDDEDDVVESANKDEEGGKTEKSNGEEEAAAAAAAAEEVKPX

SEQ ID NO: 11519 - protein, 290 aa, Zea mays
  misc_feature (290)..(290): Xaa can be any naturally occurring amino acid
  unsure (1)..(290): unsure at all Xaa locations
HTAPLPCLPFPSPSSSPHPPTHPLQSFPQPMAAAAAAAGTREEMVYMAKLAEQAERYEEMVEFMEKVAAAAELTVEERNLLSVAYKNVIGARRASWRIVSSIEHKEETRGAAGHAAAARGYRARVEAELSGICAGILRLLDERLVPAAAAVDARVFYLKMKGDYHRYLAEFKTGAERKDAADSTLAAYQAAQDIAVKELPPTHPIRLGLALNFSVFYYEILSSPDRACSLAKQAFDEAISELDSLGEESYKDSTLIMQLLRDNLTLWTSDMQEDGGDEMRDANKPDEEQX

SEQ ID NO: 11520 - protein, 253 aa, Oryza sativa
  misc_feature (253)..(253): Xaa can be any naturally occurring amino acid
  unsure (1)..(253): unsure at all Xaa locations
FGMRVAATTRPASSSAAAPLPLFLLLAVAAAAAALFLVGSASLAMAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQX

SEQ ID NO: 11521 - protein, 381 aa, Oryza sativa
  misc_feature (381)..(381): Xaa can be any naturally occurring amino acid
  unsure (1)..(381): unsure at all Xaa locations
SVCQHPPGGRSGATSHLTYCFRQPPPDTMADSPSPRLDEEDAFGRDFNSSPSPTAPPARSGEKRPFGDLDDDDEDVFASKKGKTKVEESAPGAATGMILSLRESLQNCKDNLASCQVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVETX

SEQ ID NO: 11522 - protein, 348 aa, Zea mays
  misc_feature (348)..(348): Xaa can be any naturally occurring amino acid
  unsure (1)..(348): unsure at all Xaa locations
MEFKRDVWSLLLVLLLGQLVAFSMAASSFASSLIANLGVDAPLTQSFLAYLLLTLVYVPIVLRRRQKLQIAWYWYLALAFFDVQGNYLVVKAYQYSYITSVTLLDCWTVVWVVMLTWYALGTRYSLWQFVGAGTCVAGLALVLLSDAKSQDEQDPKKIPLLGDALVIAGTVGFAFSNVGEEYCVKKKDRAEVVAMLGLFGLLISTVQILVFERKGLEAVTWSPTMISLFAGFAVAIFVFYTVAPFVLKMSGATLFNLSLLTSDMWAVAIRVLFYQQEINRLYYLAFTVVAIGLIIYSLNDRSSDDETAGSTEAPAQYQQLPIEDNSTRIGSSSGSQERTHKEEVHICX

SEQ ID NO: 11523 - protein, 171 aa, Zea mays
  misc_feature (171)..(171): Xaa can be any naturally occurring amino acid
  unsure (1)..(171): unsure at all Xaa locations
IGLSRTYLLYYTLGSKDTTAMAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLQQQLPFMFNPMAMTIPPMFLQQPFVGAAFX

SEQ ID NO: 11524 - protein, 171 aa, Zea mays; identical to SEQ ID NO: 11523
  misc_feature (171)..(171): Xaa can be any naturally occurring amino acid
  unsure (1)..(171): unsure at all Xaa locations

SEQ ID NO: 11525 - protein, 171 aa, Zea mays; identical to SEQ ID NO: 11523
  misc_feature (171)..(171): Xaa can be any naturally occurring amino acid
  unsure (1)..(171): unsure at all Xaa locations

SEQ ID NO: 11526 - protein, 146 aa, Zea mays
  misc_feature (146)..(146): Xaa can be any naturally occurring amino acid
  unsure (1)..(146): unsure at all Xaa locations
SSDGADKTRPSNKCQRPLAVAAMESTFIMIKPDGVQRGLIGEIISRFEKKGFYLKALKLVNVERSFAEKHYADLASKPFFQGLVDYINPLASEPGTIRGDFAVDIGRNVIHGSDSIESANKEIVLWFPEGPADWQSSQHPWIYEKX

SEQ ID NO: 11527 - protein, 355 aa, Zea mays
  misc_feature (355)..(355): Xaa can be any naturally occurring amino acid
  unsure (1)..(355): unsure at all Xaa locations
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLRLRVVWTISSLIAASTRHYLLRSIINGHPTLQSLVLTDADGQGTLCMGAKQLEEFRENQLSTSACSNRTQVPACNMKLKYAPYVELPGGMALQGATLVAIKPSPEGSNGSHPNRKEAEGFVFGAFDGPFKAAVKALMKRRTYLLEMNGFX

SEQ ID NO: 11528 - protein, 306 aa, Zea mays
  misc_feature (306)..(306): Xaa can be any naturally occurring amino acid
  unsure (1)..(306): unsure at all Xaa locations
MRFGMNLGGETSKRKQNRTNEPASAHANQEKRWVLSDFEVGKPLGRGKFGHVYLAREKRSSEIVALKVLFKSQLKQSQVEHQLRREVEIQSHLRHPNILRLYGYFYDQTRVYLILEYAAKGELYKELTRCKHFSERRTATYVASLARALIYLHGKHVIHRDIKPENLLVGVQGEIKIADFGWSVHTFNRRRTMCGTLDYLPPEMVEKAEHDYHVDIWSLGVLCYEFLYGVPPFEAKEHSETYRRIVKVDLKFPLKPFVSPAAKDLISQMLVKSSAQRLPLHKVLEHPWIVQNADPSGVYREGRSIX

SEQ ID NO: 11529 - protein, 130 aa, Glycine max
  misc_feature (130)..(130): Xaa can be any naturally occurring amino acid
  unsure (1)..(130): unsure at all Xaa locations
IGANIAWPNSDFINKEYPFIVGGLMVRFNLFRLVWRTIFVILATILAMVMPFFSEVLSLLGAIGFGPLVVFIPIQMHIAQKSIRKLSLRWCGLQFLSCLSFIVSLGAVVGSVHGIIQDFHKSDLFMYKQX

SEQ ID NO: 11530 - protein, 443 aa, Zea mays
RRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVSRELRVGPLALSVFRLTWRSAFVCVTTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 11531 - protein, 497 aa, Zea mays
EFPGRPTRPPTRPPTRPPTRPPTRPLLSFPGTCHGRRMDKSGGEAAAAAAAADDVERRGGDYEQDEHERRGTVWTATAHIVTAVIGSGVLALAWSVAQLGWVAGPLALAGFACVTYYTSTLLAGAYRAPHPVTGHRNRTYMDAVRSYLSPREVFMCGVAQYVNLWGTMVGYTITATISMAAIRQADCLRRDGAGAGARCDAPGTVLMLAFSVVQVVLSQFPGLEHITWLSVVAAAMSFAYSFAGLGLSVGHWVSRGGGGLGGRVAGAAAASSTRKLWNVLLALGNIAFAYTFAEVLIEIQDTLKSPPPENRTMKKAAMYGIGATTIFYISVGCAGYAAFGSNAPGNILAAGGLGPLWLVDIANMCLILHLIGAYQVYAQPVFASVERWAASRWPEAKFMSSAYTVSVSIPLLQRGSVTVAPHKLVLRTAIVGATTAVALAIPFFNAVLGLLGAFSFWPLTVYFPISMHIAQGKIARGTKWWCLLQALSMVCLVISVA

SEQ ID NO: 11532 - protein, 508 aa, Zea mays
NSRVDPRVRGRVGGRVGGRVGADELYSLLTVLVTRLATRHELRALRFPNAGCWPMAQHHGSHSLEVGGVGAGGVELDDDGHAARTGNLWTCFAHIITAVIGCGVLALSWSVAQLGWVGGPVAMLCFAFVTYLSAFLLSHCYRSPASDDGSLKRQRNYTYMDAVRTHLGEKRTWLCGLFQYLNMYGTAIAYTITTATCLRAIVRANCYHSQGHSAPCGAGGDHLYMLLFGAAQAVLSLIPNFHSMAWLSAVAAVMSFTYATIGLGLGLAKTIENGAIKGSVAGVPMSTAPQKVWRVAQAIGDIAFAYPYTIVLLEIQDTLKSPPPESETMQKGNVLAVLATTFFYLAVGCFGYAAFGNAAPGNLLTGFGFYEPYWLIDFANACIVLHLLGGYQMFSQQIFTFADRSLAARFPNSAFVNKSYAVKVPGAPASWSYSLNLQRLCFRTAYVASTTGLALLFPYFNEVLGVLGAVVFWPLAIYLPVEMYCVQRGVLPWTRTWVALQAFSVVCF

SEQ ID NO: 11533 - protein, 351 aa, Zea mays
VVSVMKYCDIFRGEWVPDAEAPYYNHKTCHMIQEHQNCLKYGRPDLGFLKWRWRPSGCELPRFDPLQFLQFARGKSLAFVGDSLARNHMQSLLCLLSQVAYPKDLSANPSDQNKVYHYRAYNFTISMFWSPFLVRAREPDHDGPAHTGHWSLYLDEPDDKWVSQMPRFDYVLVSAANWFSRPSLFYERRRLVGCSFCSRQYGVPDLTLYYSQRRAWRVALRAINDLERLRGRVIVRMLSPMSHFENGTWDHGGDCRRTQPLRANQTAMEGRDLHFYTAQMEEFRAAEKAAAEKGRRLMLMDATAAMLMRPDGYPSRYGHWPNEKVQLYNDCIHWCLPGPIDIWNDMLFQML

SEQ ID NO: 11534 - protein, 293 aa, Zea mays
VRECLEEVGHITRLADPRDAWLPITESRSGNAYYAAFHNLSSGIGFQALVLPTAFASLGWTWAIICLTLAFGWQLYTLWLLVRLHEPVAGATRYSRYMHLATTVFGERWAKILALLPVMYLSAGICTALIIVGGGSMKLLFGIACGEPCPARPPTTVEWYLVFVCAAVLLSQLPNLNSIAGVSLVGATAAVAYCTMIWTVSVAKGRVPAVSYDPVKAPSDVDGALAILNGLGIIAFAFRGHNVVLEIQGTMPSTLKHPSHVPMWKGVKVAYAIIALCLYPVAIGGFWAYGNQV

SEQ ID NO: 11535 - protein, 444 aa, Zea mays
  misc_feature (111)..(111): Xaa can be any naturally occurring amino acid
  unsure (1)..(444): unsure at all Xaa locations
EFPGRPTRPERAHHHGGDRLRGALAGVGHRAARLGGRTRRHAALLARHLLHLVAARRLLPLRRPQHRQAELHLHGRRQREPQWHQGPDLRVPAVRQHRGRGHRLHHRCLHXHARDQEGQLLPPEGTRQPLQDLQHALHDHLRRGGDLLLADPGLRPDLLALHPRRRHVLHLLLHWARPGRRPSHREQRRAGQPDRHHHRRGDPDGQGVAQPPGVRRRRLRLLLLPHPDRDPGHHPGAAAVGVDGDEARHGGERGGHHALLHAVRLHGVRGVRRRRAREPPHGLRLLRALLAPGRGQRRHRGPPGRRLPGLLPAAARLRGEVGRAAVAGLGVHHRGGRGPAPAPGEPAAVLQGEPVPGDVADGVRRGHDGRVHAAALLQRRGGLPGRARLLAAHRLLPRRDVRGAEEGAAVELPVGVPADAQPRLPRHLHRRRSRVHRRHRVRPQ

SEQ ID NO: 11536 - protein, 442 aa, Zea mays
SSRAAAAHGHVLDGQRAHHHGRHRLGSPVPGLGHRAAGLGGRPRRHAALRLRHLLHRHAARRVLPHGGPGHGQAQLHVHGRRALQPRRRQGRLLRRHPVRQPRRRRHRLHHRLLHQHAGRQQGRVLPQAWARRPLQELQQPLHDPLRRRPDPLLPDTGLRPDLVALHRRRSHVLHLLRHRLVPRHRTDCCKRWVQGKPHRHQHRRRRHLHAESVAQPAGLRRHRVRLLLLQHPHRDPRHDQGAAAVGVEGDAEGDAAERGDDDHLLHAVRVHGVRGVRRQGAGQPADGVRLLRAILADRRGQRGHRGAPGGRVPGVLPAHLRLRGAPRRRGLARQRLRRAGAPRGAPRPQRVPPHVAVGVRVRHHRGGHAAPLLRQRGGVPRRRLLLAPHRLLPRRDVHQAAPRAPRQHQVGLPPDAQRRVPGRLHRRRRRLHRRRHRGAQG

SEQ ID NO: 11537 - protein, 700 aa, Zea mays
AGTQTQPPTTNPPPVLFSSSRRRNRLLALCALILASVEGRLDMASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWIEKTTEKEISDDEDEEDKKDEEGKVEDVDEKEEKEKKKKKIKEVSHEWQLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSTNRNKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKRKEELKEKFEGLCKVIKEVLGDKVEKVVVSDRVVDSPCCLVTGEYGWTANMERIMKAQALRDSSMSGYMSSKKTMEINPDNAIMEELRKRAEADKNDKSVKDLVMLLFETALLTSASALTTPTPSAAL

SEQ ID NO: 11538 - protein, 304 aa, Zea mays
  misc_feature (304)..(304): Xaa can be any naturally occurring amino acid
  unsure (1)..(304): unsure at all Xaa locations
MNTSPSRYRAMMGGWGGSDGYEGSKRTRMMMESNPYFAVNAGSPLDVSKRARMMEPGAPYFGAMGSSASGAGGGFYQPFNSNLAGAGSSTGIQSFPCVRLRGLPFDCNDIDVCKFFVGLDIVDCLLVNKNGRFTGEAFVVFPTAMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRSDGKATGEAFVEFPTAEVAKTAMCKDKMTIGTRYVELFPSTPEEASRAKSRGRHX

SEQ ID NO: 11539 - protein, 246 aa, Zea mays; identical to SEQ ID NO: 11235
  misc_feature (246)..(246): Xaa can be any naturally occurring amino acid
  unsure (1)..(246): unsure at all Xaa locations

SEQ ID NO: 11540 - protein, 232 aa, Zea mays
  misc_feature (232)..(232): Xaa can be any naturally occurring amino acid
  unsure (1)..(232): unsure at all Xaa locations
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKLAEKQKDQRQQVQRDQTQQQTSSSSMSFMLREAAPTTNVSIFPVAAGGRVVEGAAAQPQARVGLPPWMLSHLSCX

SEQ ID NO: 11541 - protein, 671 aa, Zea mays
MAPPSMCLAAKGVLPFSALISSGVTQRPVSVTASLEHKTSDARRKFLKLALGNIGVGLPTLLGVKKALADEQGISSSRMSYSRFLEYLDKGRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGGNKKFDSDVSLDVIAMRTPGFSGADLANLLNEAAILARRRGRTAISSKEIDDSIDRIVAGMEGTVMTDGKSKSLVAYHEVGHAICGTLTPGHDPVQKVTLIPRGQARGLTWFIPMDDPTLISRQQLFARIVGGLGGRAAEEVIFGEPEVTTGAAGDLQQITGLAKQMVVTFGMSEIGPWSLMEGGAQSGDVIMRMMARNSMSEKLAEDIDSAVKQLSDEAYEIALRHIRNNREAIDKIVEVLIEKETLAGDEFRAILSEFVEIPVENRVPPATP

SEQ ID NO: 11542 - protein, 224 aa, Zea mays
GVATIPGLVLAGVVRLRSSMGRSPCCDENGLKKGPWTQEEDEKLLHYIQKNGHGSWRTLPRLAGLNRCGKSCRLRWTNYLRPDIKRGKFSQEEEQTILHLHSVLGNKWSAIATHLPGRTDNEIKNFWNTHLKKRLIQMGFDPMTHRPRTDLFAALPQLIALAALREQLSALCSPQLTAATTAPSADDGDRQSSYLPCTFPVSSDGQEAANQQQQTGLISYDGGP

SEQ ID NO: 11543 - protein, 252 aa, Zea mays
  misc_feature (252)..(252): Xaa can be any naturally occurring amino acid
  unsure (1)..(252): unsure at all Xaa locations
MMEPGAPYFGAMGSSASGAGGGFYQPFNSNLAGAGSSTGIQSFPCVRLRGLPFDCNDIDVCKFFVGLDIVDCLLVNKNGRFTGEAFVVFPTSMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRHX

SEQ ID NO: 11544 - protein, 246 aa, Zea mays
  misc_feature (246)..(246): Xaa can be any naturally occurring amino acid
  unsure (1)..(246): unsure at all Xaa locations
MGRGKVQLKRIENKINRQVTFSKRRSGLLKKAHEISVLCDAEVALIIFSTKGKLYEYSTDSCMDKILDRYERYSYAEKVLISAESETQGNWCHEYRKLKAKVETIQKCQKHLMGEDLETLNLKELQQLEQQLESSLKHIRTRKNQLMLESISELQRKEKSLQEENKVLQKELAEKQKAQRKQVQWGQTQQQTSSSSSCFVIREAAPTTNISIFPVAAGGRLVEGAAAQPQARVGLPPWMLSHLSSX

SEQ ID NO: 11545 - protein, 161 aa, Zea mays; identical to SEQ ID NO: 10148
  misc_feature (161)..(161): Xaa can be any naturally occurring amino acid
  unsure (1)..(161): unsure at all Xaa locations

SEQ ID NO: 11546 - protein, 204 aa, Brassica napus
  misc_feature (100)..(100): Xaa can be any naturally occurring amino acid
  misc_feature (107)..(107): Xaa can be any naturally occurring amino acid
  misc_feature (153)..(153): Xaa can be any naturally occurring amino acid
  misc_feature (157)..(157): Xaa can be any naturally occurring amino acid
  misc_feature (180)..(180): Xaa can be any naturally occurring amino acid
  misc_feature (194)..(194): Xaa can be any naturally occurring amino acid
  unsure (1)..(204): unsure at all Xaa locations
YSHQSWRLQSRNPSLQPLSVSTPTERTTFPSQIASRYLLGSDIPHRLPSIWSQNHHRPRLAFPISLEPKALMIIFQTQSFTRWKQLSGHGESSMFHRLYXKLGFEVXRFLMSEGLVHKVDPKRDMVGLSSLKTSSLLKLRWRSLLRKNKWSLXSTPXSMEQEQERSEMAKYSFCLCQMSXGFGQVSVENKQRRXLVTCFRHLRH

SEQ ID NO: 11547 - protein, 182 aa, Zea mays
  misc_feature (182)..(182): Xaa can be any naturally occurring amino acid
  unsure (1)..(182): unsure at all Xaa locations
LYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11548 - protein, 515 aa, Zea mays
  misc_feature (515)..(515): Xaa can be any naturally occurring amino acid
  unsure (1)..(515): unsure at all Xaa locations
MVVSEIRRCLNEGIEFQGELLNFRKDGAPLYNRLSLIPMHGDDGYVTHVIGIQLFSEANIDLSSVSYPVYKQQTNNRPIIQDLNSASHEHAPKVQSADHCGILQLSDEVLAHNILSRLSPRDVASIGSVCTRMHELTKNDHLRKMVCQNAWGRDATVKLEMSTKMVGWGRLARELTTLEAASWRKFTVGGRVEPSRCNFSACAVGNRLVLFGGEGVNMQPMDDTFVLNMEAARPEWRRVKVSASPPGRWGHTLSWLNGSWLVVFGGCGQQGLLNDVFVLDLDAQQPTWREVASEGPPLPRSWHSSCTLDGSKLVVSGGCTESGVLLSDTFLLDLTKEKPAWREIPTSWSPPSRLGHTMSVYGTTKLLMFGGLAKSGSLRLRSSDAYTMDVGEDSPQWRQLATTGFPNVGPPPRLDHVAVSLPCGRIIIFGGSIAGLHSPAQLFLVDPAEEKPTWRILNVPGKPPKFAWGHSTCVVGGTRVLVLGGHTGEEWILNELHELCLASRPDDDDDTATDX

SEQ ID NO: 11549 - protein, 184 aa, Zea mays; identical to SEQ ID NO: 11326
  misc_feature (184)..(184): Xaa can be any naturally occurring amino acid
  unsure (1)..(184): unsure at all Xaa locations

SEQ ID NO: 11550 - protein, 411 aa, Arabidopsis thaliana
  misc_feature (411)..(411): Xaa can be any naturally occurring amino acid
  unsure (1)..(411): unsure at all Xaa locations
LVHKKITFLIGPEVSAHFFKASESDLSQQEVYQFNVPTFGPGVVFDVDYSVRQEQFRFFTEALRVNKLKGYVDMMVTEAEDYFSKWGESGEVDIKVELERLIILTASRCLLGREVRDQLFDDVSALFHDLDNGMLPISVLFPYLPIPAHRRRDRAREKLSEIFAKIIGSRKRSGKTENDMLQCFIESKYKDGRQTTESEVTGLLIAALFAGQHTSSITSTWTGAYLMRYKEYFSAALDEQKNLIAKHGDKIDHDILSEMDVLYRCIKEALRLHPPLIMLMRASHSDFSVTARDGKTYDIPKGHIVATSPAFANRLPHIFKDPDTYDPERFSPGREEDKAAGAFSYIAFGGGRHGCLGEPFAYLQIKAIWSHLLRNFELELVSPFPEIDWNAMVVGVKGNVMVRYKRRQLSX

SEQ ID NO: 11551 - protein, 452 aa, Glycine max
  misc_feature (452)..(452): Xaa can be any naturally occurring amino acid
  unsure (1)..(452): unsure at all Xaa locations
KKKERNKDRSLLCSKIRSSKMVLSWSRRNVFRRAKKEKSQTQLEVEVVIPNHFHCPVSLELMTDPVTLSTGITYDRVSIEKWIEGGNRTCPVTNQVLTTFDIIPNHAIRRMIQDWCVENSSYGIDRIPTPRIPISAYEVSDTCTRILSACQRGDDKRCQELVGKIKVWSRESERNKRCIVGAGAGAVLAYAFDCFSSNSIEKHVVLLEEVLEVMTWMVPLGEEGVSKLSSGASLNSLVWFLEGKDLASRQSAALLLKEVCVQELAKVGEVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLLVLLQVGCDESPKENATGLLKLLNGYRNKAECTDSSLNFEHLKKPFX

SEQ ID NO: 11552 - protein, 617 aa, Glycine max
  misc_feature (617)..(617): Xaa can be any naturally occurring amino acid
  unsure (1)..(617): unsure at all Xaa locations
PRTGRYSADAAGGDAAVELTRRCRHAAAAIGDLIFIYGGLRGGVLLDDLLVAEDLAAAETTAASHAAAAAAASNVQAGRLPGRYGFIDDRTRQTMPETDPDGSVVLGNPVAPPVNGDMYTDISTENALLPGSRRTSKGVEYLVEASAAEAEAISATLAAAKARQVNGEVELPDRDRGAEATPSGKQISSLIKPDSAGSNSIPPGGVRLHHRAVVVAAETGGALGGMVRQLSIDQFENEGRRVSYGTPESTTAARKLLDRQMSINSVPKKVVAHLLKPRGWKPPVRRQFFLDCNEIADLCDSAERIFSSEPSVLQLRAPIKIFGDLHGQFGDLMRLFDEYGAPSTAGDIAYIDYLFLGDYVDRGQHSLETISLLLALKVEYPNNVHLIRGNHEAADINALFGFRIECIERMGERDGIWTWHRINRLFNWLPLAALIEKKIICMHGGIGRSINHVEQIENIQRPITMEAGSIVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHPLPPAISSPETSPERHIEDTWMQELNANRPPTPTRGRPQVTNDRAX

SEQ ID NO: 11553 - protein, 405 aa, Glycine max
  misc_feature (405)..(405): Xaa can be any naturally occurring amino acid
  unsure (1)..(405): unsure at all Xaa locations
QEASSEILPINFDGLAKAVKKGDTIFIGQYLFTGSETTSVWLEVSEVKGQDVVCIIKNTATLAGSLFTLHASQIHIDLPTLTEKDQEVISSWGVKNKIDFLSLSYTRHAEDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKFALDHGKALGVIKSHDRVVVCQKLGDASVVKIIELEDX

SEQ ID NO: 11554 - protein, 313 aa, Glycine max
  misc_feature (313)..(313): Xaa can be any naturally occurring amino acid
  unsure (1)..(313): unsure at all Xaa locations
GRESNCTHCNSLTVSSALMEQYEKVEKIGEGTYGVVYKGRDRSTNETIALKKIRLEQEDEGVPSTAIREISLLKEMQHRNIVRLQDVVHDEKSLYLVFEYLDLDLKKHMDSSPEFAKDPRQLKMFLYQILCGIAYCHSRRVLHRDLKPQNLLIDRSNNALKLADFGLARAFGIPVRTFTHEVVTLWYRAPEILLGSHHYSTPVDIWSVGCIFAEMVNQRPLFPGDSEIDELFKIFRIMGTPNEDTWPGVTSLPDFKSAFPKWQPKDLKIVVPNLKPAGLDLLSSMLYLDPSKRITARSALEHEYFKDIKFVPX

SEQ ID NO: 11555 - protein, 520 aa, Glycine max
  misc_feature (520)..(520): Xaa can be any naturally occurring amino acid
  unsure (1)..(520): unsure at all Xaa locations
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMAPYKYRGALNIGFQLSITVGILVANVLNYFFAKIHGGWGWRLSLGGAMVPALIITIGSLVLPDTPNSMIERGDREKAKAQLRRVRGIDDVEEEFNDLVAASESSRKVEHPWRNLLQRKYRPHLTMAVLIPFFQQLTGINVIMFYAPVLFSSIGFKDDSALMSAVITGVVNVVATCVSIYGVDKWGRRALFLEGGVQMVICQAVVAAAIGAKFGIDGNPGDLPKWYAVVVVLFICIYVSAFAWSWGPLGWLVPSEIFPLEIRSAAQSINVSVNMFFTFLIAQVFLTMLCHMKFGLFIFFAFFVLIMTFFIYFFLPETKGIPIEEMNQVWKAHPFWSRFVENDDYGNGVEMGRGTAIKEVX

SEQ ID NO: 11556 - protein, 636 aa, Glycine max
  misc_feature (636)..(636): Xaa can be any naturally occurring amino acid
  unsure (1)..(636): unsure at all Xaa locations
MKNLSTNELKQLADELRSDVIFSVSRTGGHLGSSLGVVELTVALHYVFNAPQDKILWDVGHQSYPHKILTGRRDKMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNINDLVAILNEVKSTNTTGPVLIHVITEKGRGYPYAEKAADKYHGVTKFDPPTGKQFKSKATTRSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEAELFHMVATAAAINDRPSCFRYPRGNGIGVQLPTGNKGTPLEIGKGRILIEGERVALLGYGSAVQNCLAAASLVEHHGLRVTVADARFCKPLDRSLIRSLAKSHEVLITVEEGSIGGFGSHVAQFMALDGLIDGKLKWRPIVLPDRYIDHGSPADQLSLAGLTPSHIAATVFNILGQTREALEVMSX

SEQ ID NO: 11557 - protein, 397 aa, Glycine max
  misc_feature (397)..(397): Xaa can be any naturally occurring amino acid
  unsure (1)..(397): unsure at all Xaa locations
MRALQSQCCSPDEVIFGPDFFQSLYCHLLCGLIFREEVEFVSSTFAHSIVHAFRTFEQVWEELCNDIREGVLTRNVTVPSIRMAMSKLLKPNPELANAIHKKCTGLSNWYGLIPELFPNAKYIYGIMTGSMEPYLKKMRHYAGELPLLTADYGSSEGWIAANVNPQLPPEYATYAVLPHIGYFEFIPLLELENTKPLGLTQVKVGQEYEIVMTNPAGLYRYRLGDVVKVMGFHNSTPELKFIRRSSLLLNINIDKNTEKDLQLAVEAAGKLLAEEKLEVVDFSSQVDLSKEPGHYVIFWEISGDASQELLHECCNCLDKSFVDAGYTSSRKVNCIGALELRLVRRGTFQKILDHYLGLGTAVSQYKTPRCVGPTNTRVLQILSENVVNNYLSTAFNX

SEQ ID NO: 11558 - protein, 197 aa, Glycine max
  misc_feature (197)..(197): Xaa can be any naturally occurring amino acid
  unsure (1)..(197): unsure at all Xaa locations
IYTFISMWFVGGLTAFHLYLISTNQTTYENFRYRYDRRANPYNTGVFNNFLEIFCTSIPQSKNNFRAKVPMEPVLPARSVGGGFMSPSMGKAVDDIEMGRKTVWADMGTALDPSEGQLNDRVAVKDGEFGELSPEIRTTVDETSHRAGMHPRRSSWGRKSGSWEMSPEVLALAAKVGESNRMGGGSSSLTTENRHTX

SEQ ID NO: 11559 - protein, 446 aa, Glycine max
  misc_feature (446)..(446): Xaa can be any naturally occurring amino acid
  unsure (1)..(446): unsure at all Xaa locations
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPYX

SEQ ID NO: 11560 - protein, 633 aa, Glycine max
  misc_feature (633)..(633): Xaa can be any naturally occurring amino acid
  unsure (1)..(633): unsure at all Xaa locations
PLKTKPHHHLTHSHFSLSSRFYCFLMDTNIGSLSLDACKPANNDVGCPPNGAVSAIKPSVPATTMTSSDATLGRHLARRLVQVGVTDVFSVPGDFNLTLLDHLIAEPQLKNIGCCNELNAGYAADGYARCRGVGACVVTFTVGGLSVINAIAGAYSENLPLICIVGGPNTNDFGTNRILHHTIGLSDFSQELRCFQTVTCYQAVVNNIEDAHELIDTAISTCLKESKPVYISISCNLPGIPHPTFSREPVPFSLSPRLSNKMGLEAAVEAAAEFLNKAVKPVMVGGPKLRVANACDAFVELADACGYPFAVMPSAKGLVPEHKPHFIGTFWGAVSTAFCAEIVESADAYLFAGPIFNDYSSVGYSLLLKKEKAIIVQPERVVISNGPAFGCVLMKDFLRELAKRLKHNNTAYENYSRIFVPEGKPVKAEPREPLRVNVLFKHIQDMLSGETAVIAETGDSWFNCQKLKLPKGCGYEFQMQYGSIGWSVGATLGYAQAVPEKRVISCIGDGSFQVTAQDVSTMLRNEQKTIIFLINNGGYTIEVEIHDGPYNVIKNWNYTGLVDAIHNGEGKCWTTKVTCEEELVEAIQTATGDKKDCLCFIEVIVHKDDTSKELLEWGSRVCAANGRPPNPQX

SEQ ID NO: 11561 - protein, 512 aa, Glycine max; identical to SEQ ID NO: 10543
  misc_feature (512)..(512): Xaa can be any naturally occurring amino acid
  unsure (1)..(512): unsure at all Xaa locations

SEQ ID NO: 11562 - protein, 501 aa, Glycine max
  misc_feature (501)..(501): Xaa can be any naturally occurring amino acid
  unsure (1)..(501): unsure at all Xaa locations
LSSLCGHHSCWRFQLFLLQTSWVYVMMALNISSPAEVKSIFFADYFKSNCITAKFTGGFAFKRKERGAASGGRVCCSVLAPPPPPAWPGRAVPEQGSKTWDGPKPISIVGCTGSIGTQTLDIVAENPDKFKVVALAAGSNVTVLADQVKRFKPQLVAVRNESLIAELKEALHDVEEKPEIIPGEQGIIEVARHPDAVSVVTGIVGCAGLKPTVAAIEAGKYIALANKETLIAGGPFVLPLAQKHNVKILPADSEHSAIFQCIQGLPEGALRRVILTASGGAFRDWPVDKLKDVKVADALKHPNWNMGKKITVDSATLFNKGLEVIEAHYLFGADYDHIEIVIHPQSIIHSMIETQDSSVLAQLGWPDMRLPILYTLSWPDRIYCSEDTWPCLDLCKIGSLTFKTPDNVKYPSMNLAYAAGRAGGTMTGVLSAANEKAVEMFIDEKISYLDIFKVVELTCEKHQNELLSSPSLEEIIHYDLWAREFAASLQDSSSFTPILAX

SEQ ID NO: 11563 - protein, 172 aa, Glycine max
  misc_feature (172)..(172): Xaa can be any naturally occurring amino acid
  unsure (1)..(172): unsure at all Xaa locations
YVVLCDRQQRNTPKQTMDVGQMQRQWIDYTKSLFLEGFLDGQFLQLQQLQDENNPDFVVEVVSLFFEDSERLLKDLTFALDQNGVDFKKVDAHVHQLKGSSSSIGAQRVKNACIAFRNFCEEQNTDACVRCLQQVKQEYCLVKNKLETMFRLEQQIVAAGGSIPTELSFSGX

SEQ ID NO: 11564 - protein, 317 aa, Oryza sativa
  misc_feature (317)..(317): Xaa can be any naturally occurring amino acid
  unsure (1)..(317): unsure at all Xaa locations
AAAAEQQQQASDMGGFVKTQKTHAYFKRFQVKFKRRRQGKTDYRARIRFTNQDKNKYNTPKYRFVVRFTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDEX

SEQ ID NO: 11565 - protein, 262 aa, Oryza sativa
  misc_feature (262)..(262): Xaa can be any naturally occurring amino acid
  unsure (1)..(262): unsure at all Xaa locations
KMSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGHX

SEQ ID NO: 11566 - protein, 241 aa, Oryza sativa
KGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 11567 - protein, 398 aa, Oryza sativa
  misc_feature (398)..(398): Xaa can be any naturally occurring amino acid
  unsure (1)..(398): unsure at all Xaa locations
SLSSPSLSSLARSSSAARAPATRRVGPADNRREGEAPSPWGAPMTSCGCLVLEKVEDHGGEAAGRGRGRLAQGGGGGGGGCGSCAGEWRSRSETMFPIYVMGSSRASSAAAARGIVDAAGDPIWEAVKSEAKSEAEKEPILSSFLYASVLSHDCLERALSFVLANRLEDPTLLATQLIDIFNDVMMNNKDIRRSIRLDAQAFKDRDPACAQYSWALLYLKGYHSVQSYRIAHVLWNQGRKVLALALQSRISEVFAVDIHPAARIGEGILLDHGTGLVIGETAIVGNWVSLMQGVTLGGTGKENGDRHPKIGQGALLGAGATILGNINVGEGAMIAAGSLVLKDVPPHSMAVGNPAKVVGYKDKEDPSLTMKHDARRDYFEHVAVSFSDDKANGSVVKX

SEQ ID NO: 11568 - protein, 369 aa, Oryza sativa
  misc_feature (369)..(369): Xaa can be any naturally occurring amino acid
  unsure (1)..(369): unsure at all Xaa locations
ERERAVQVSLAMARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEAFTYNLWRERERERDFGGFX

SEQ ID NO: 11569 - protein, 263 aa, Oryza sativa; identical to SEQ ID NO: 10627
  misc_feature (263)..(263): Xaa can be any naturally occurring amino acid
  unsure (1)..(263): unsure at all Xaa locations

SEQ ID NO: 11570 - protein, 248 aa, Oryza sativa
  misc_feature (248)..(248): Xaa can be any naturally occurring amino acid
  unsure (1)..(248): unsure at all Xaa locations
AKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDAGEGQX

SEQ ID NO: 11571 - protein, 238 aa, Oryza sativa
  misc_feature (238)..(238): Xaa can be any naturally occurring amino acid
  unsure (1)..(238): unsure at all Xaa locations
SACRGDRRRAHRSTPPSPPPVNGSMSRHPEVKWAQRIDKVYITVQLADAKDAKVNLEPEGVFSFSATAGTDGNLYESKLELNDKVNVEESKISVGVRSIFCIVEKAEAKWWKKLVRDDQKAPHFVKVDWDKWVDEDDDGADVNVDGMDFSNFGGMGGMGGMGGMGDMMGGMGGMGGMGGMAEMMGGMGGMGGMGGMGGMDEFEDESDDEEEVSKPQDAEKAAEAGKSQESDAKAETSX

SEQ ID NO: 11572 - protein, 140 aa, Oryza sativa
  misc_feature (140)..(140): Xaa can be any naturally occurring amino acid
  unsure (1)..(140): unsure at all Xaa locations
RKYRVAGLVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANAX

SEQ ID NO: 11573 - protein, 482 aa, Oryza sativa
MAVDMELDGGGDGKGKAPPQISLSGLFLACMVAGGVQYGWALQLSLLTPYVQTLGIPHALTSVMWLCGPIAGLIVQPCVGLYSDKCTSSLGRRRPFILTGCIIICISVIVIGFSSDIGYALGDTTEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGLLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLAASRGGGQGLCTGVLNISIVVPQMAIALGAGPWDELFGEGNIPAFAMASVFAA

SEQ ID NO: 11574 - protein, 263 aa, Oryza sativa; identical to SEQ ID NO: 11124
  misc_feature (263)..(263): Xaa can be any naturally occurring amino acid
  unsure (1)..(263): unsure at all Xaa locations

SEQ ID NO: 11575 - protein, 496 aa, Oryza sativa
  misc_feature (496)..(496): Xaa can be any naturally occurring amino acid
  unsure (1)..(496): unsure at all Xaa locations
HTSSNPPTPRSIRSSCEVSDMASGQKVVKPMEVSVEAGNAGEAAWLDDDGRARRTGTFWTASAHIITAVIGSGVLSLAWAIAQLGWVAGPAVMLLFAFVIYYTSTLLAECYRTGDPATGKRNYTYMDAVRANLGGAKVTFCGVIQYANLVGVAIGYTIASSISMRAIRRAGCFHHNGHGDPCRSSSNPYMILFGAVQIVFSQIPDFDQIWWLSIVAAVMSFTYSGIGLSLGIVQTISNGGIQGSLTGISIGVGVSSTQKVWRSLQAFGDIAFAYSFSNILIEIQDTIKAPPPSEAKVMKSATRLSVATTTVFYMLCGCMGYAAFGDAAPDNLLTGFGFYEPFWLLDVANVAIVVHLVGAYQVFVQPIFAFVERWASRRWPDSAFIAKELRVGPFALSLFRLTWRSAFVCLTTVVAMLLPFFGNVVGLLGAVSFWPLTVYFPVEMYIAQRGVPRGSARWVSLKTLSACCLVVSIAAAAGSIADVIDALKVYRPFSGX

SEQ ID NO: 11576 - protein, 408 aa, Oryza sativa
  misc_feature (408)..(408): Xaa can be any naturally occurring amino acid
  unsure (1)..(408): unsure at all Xaa locations
AMSFRSVIQEVKGEIGAISRRGFRSRPGRVRRVAAAAEEPPDESSAAALVMRESCWTQLPPELLREVLARVEESEGWWPRRRDVVACAGVCRSWRGIVREIVRTPEASGNLTFPISLKQPGPRDAPMKCFIVRNRTTQTYYLYIGLTDALTDDGKFLLAARKCRRTTCTEYLISLDMNDISKRTDSYVGKLRSNFLGTKFTIYDAHPPYAGDVISKGQSARVIGSNHLSPRIPAGNYPVSHISYELNVLGSRGPRRMHCAMDSIPVSAIEQGGTAPTQTEFPLSYHESFTSIPFFKSKSVRANNSTASLLTQNGSKLVLKNKSPRWHEHLQCWCLNFHGRVTVASVKNFQLVASDESNPTNQEHDDVILQFGKVGKDMFTMDYRYPISAFQAFAICLSSFDTKIACEX

SEQ ID NO: 11577 - protein, 458 aa, Oryza sativa
  misc_feature (458)..(458): Xaa can be any naturally occurring amino acid
  unsure (1)..(458): unsure at all Xaa locations
AAAAAVPLISDRPKHAAIVRSGTEWTAAAHVITAVIGSGVLSLAWSVAQLGWLAGPGMMLVFAAVTALQSALFADCYRSPDPEVGPHRNRTYANAVERNLGSSSAWVCLLLQQTALFGYGIAYTITASISCRAILRSNCYHTHGHDAPCKYGGSYYMLMFGAAQLFLSFIPDFHDMAWLSVLAAVMSFSYSFIGLGLGLANTIANGTIKGSITGAPTRTPVQKVWHVSQAIGDIAFAYPYSLILLEIQDTLKAPPAENKTMKKASIISIVVTTFFYLCCGCFGYAAFGSDAPGNLLTGFGFYEPYWLIDFANACIILHLLGGYQVYSQPIYQFADRFFAERYPASRFVNDFHTVKLPLLPPCRVNLLRVCFRTVYVASTTAVALAFPYFNEVLALLGALNFWPLAIYFPVEMYFIQRHVPRWSPRWVVLQSFSVLCLLVSAFALVGSIQGLISQKLGX

SEQ ID NO: 11578 - protein, 518 aa, Oryza sativa
  misc_feature (518)..(518): Xaa can be any naturally occurring amino acid
  unsure (1)..(518): unsure at all Xaa locations
SSSSSPARALRLLQLDRKQARFRSAMVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVCX

SEQ ID NO: 11579 - protein, 448 aa, Oryza sativa
  misc_feature (448)..(448): Xaa can be any naturally occurring amino acid
  unsure (1)..(448): unsure at all Xaa locations
NANRIDQLLPQVEAKSLAMSSPPPAAAAAMAVDDADDDQLASMSTEDIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYAX

SEQ ID NO: 11580 - protein, 509 aa, Oryza sativa
  misc_feature (509)..(509): Xaa can be any naturally occurring amino acid
  unsure (1)..(509): unsure at all Xaa locations
PTRPSERERGKGCDLRLASGEMAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGVSTTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKSX

SEQ ID NO: 11581 - protein, 228 aa, Oryza sativa; identical to SEQ ID NO: 11229
  misc_feature (228)..(228): Xaa can be any naturally occurring amino acid
  unsure (1)..(228): unsure at all Xaa locations

SEQ ID NO: 11582 - protein, 257 aa, Oryza sativa
  misc_feature (257)..(257): Xaa can be any naturally occurring amino acid
  unsure (1)..(257): unsure at all Xaa locations
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDAGEGQX

SEQ ID NO: 11583 - protein, 470 aa, Oryza sativa
  misc_feature (470)..(470): Xaa can be any naturally occurring amino acid
  unsure (1)..(470): unsure at all Xaa locations
MEVLLPLLLACSLLFTIATPIRDITDVCASQISDFQHLNSSGLHLTLHHPQSPCSPAPLPSDLPFSAVVTHDDARIAHLASRLANNHPTSPSSSSLLHGHRKKKAGGVGGSQASSSSVPLTPGASVAVGNYVTRLGLGTPATSYVMVVDTGSSLTWLQCSPCSVSCHRQAGPVFDPRASGTYAAVQCSSSECGELQAATLNPSACSVSNVCIYQASYGDSSYSVGYLSKDTVSFGSGSFPGFYYGCGQDNEGLFGRSAGLIGLAKNKLSLLYQLAPSLGYAFSYCLPTSSAAAGYLSIGSYNPGQYSYTPMASSSLDASLYFVTLSGISVAGAPLAVPPSEYRSLPTIIDSGTVITRLPPNVYTALSRAVAAAMASAAPRAPTYSILDTCFRGSAAGLRVPRVDMAFAGGATLALSPGNVLIDVDDSTTCLAFAPTGGTAIIGNTQQQTFSVVYDVAQSRIGFAAGGCSX

SEQ ID NO: 11584 - protein, 357 aa, Oryza sativa
  misc_feature (357)..(357): Xaa can be any naturally occurring amino acid
  unsure (1)..(357): unsure at all Xaa locations
QSLHLSPIYALASRRPMLVVVARKSSSSARVAAHQTRSHRAAMPAGQPHAHEPDGGGASHRRPQSPPSLPAEVVPAFAPPESEDEESWVWSQIKAEARRDADAEPALASFLYATVLSHPSLPRSISFHLANKLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTIX

SEQ ID NO: 11585 - protein, 289 aa, Triticum aestivum
  misc_feature (289)..(289): Xaa can be any naturally occurring amino acid
  unsure (1)..(289): unsure at all Xaa locations
QERTEIILGPGATTQDKMLLLNPASEAAAAALDSIRQQLLEEPMAPARPAYCRSASFGSLVADQWSESLPFRPNDADDMVVYGALRDAFSCGWLPDGSFAAVKPEPLPSPDSYDGCCLGSFLASPPGLDAPWAEEAEVAATASRGKHFRGVRQRPWGKFAAEIRDPAKNGARVWLGTFDSAEDAAVAYDRAAYRMRGSRALLNFPLRIGSEIAAAAGQKRPSPQPASPDSPPPSSSAPGSSKRRKRGEAAAESMSMALVPPPPVQAPVQLTLPVQPWLATGAVQQLVSX

SEQ ID NO: 11586 - protein, 297 aa, Zea mays; identical to SEQ ID NO: 11341
  misc_feature (297)..(297): Xaa can be any naturally occurring amino acid
  unsure (1)..(297): unsure at all Xaa locations

SEQ ID NO: 11587 - protein, 295 aa, Zea mays
  misc_feature (295)..(295): Xaa can be any naturally occurring amino acid
  unsure (1)..(295): unsure at all Xaa locations
VSATMEDERNTQQHQGGEAQQDAADQVDVKDRGLLDSLLGRKKHDDDQEKKKQTDELATGMEKVTVSEPEKHGHKEEEHEVVGEKKEGLLAKLHRTSSSSSSSSDEEEEAIDENGEIIKRKKKKMGLKEKLKEKLPGHKDGHHTAAPSPAPAPVETHAHHQEEAHRPHVVPTPAPPPPPHVHQHDHGVVVQDDVKTGTPPHAPEEEKKGLLDKIKEKLPGGHNKKPEAAAAAAPAPPVHAPAPAPQAENVSSPDGKEKKGLLGKIMDKIPGYHKSSAEEADHKADAAGEHRTSSX

SEQ ID NO: 11588 - protein, 216 aa, Zea mays
  misc_feature (216)..(216): Xaa can be any naturally occurring amino acid
  unsure (1)..(216): unsure at all Xaa locations
MAAHQDSAASGSGPPRCPRVLLAASGSVAAIKFEVLCRSVAEWADVHAVATASALEFIDVASFPGGVPLYTDDQEWSSWKRVGDKVLHIELRRWADVLVIAPLSANTLAKVRRTHASWSSRSPSPVAADNSACCQVAGGLCDNLLTCVVRAWDYSKPVYVAPAMNTFMWGNPFTARHLAVLRDLGMSVVPPVNGAMAEPSEICKTLMLFFGPQHLX

SEQ ID NO: 11589 - protein, 311 aa, Zea mays
  misc_feature (311)..(311): Xaa can be any naturally occurring amino acid
  unsure (1)..(311): unsure at all Xaa locations
DPVTAHLLLQTLTPLPVPIPLRKIGRGRREVDREEMHRDRGVSAAAIPGDRKRIGEPMDRSSPSTSWGFSGGREKERIGVGKQPEMPRSGGGSTAMSKSKLSDESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKPX

SEQ ID NO: 11590 - protein, 291 aa, Zea mays; identical to SEQ ID NO: 10030
  misc_feature (291)..(291): Xaa can be any naturally occurring amino acid
  unsure (1)..(291): unsure at all Xaa locations

SEQ ID NO: 11591 - protein, 126 aa, Zea mays
MAEGRGSARAIGAMAFAVACCYCCVAIADAATTYYVGDSNGWSFSSPSWPNGKHFRAGDTLVFRYIPWIHNVVAVDEDGYNGCTTPPGSRTYTSGADSVTLARGDNFFICTRFGHCNLGMKLVVYA

SEQ ID NO: 11592 - protein, 172 aa, Zea mays
  misc_feature (172)..(172): Xaa can be any naturally occurring amino acid
  unsure (1)..(172): unsure at all Xaa locations
MGGCCCCSSRTSEAVRARAPVDIYHQQNLEEQEPLSSIFDGSSPASAIVAVDTNLDTSTPDTYRAPPAPLPYDVILAVPNNPGLEKPDTKSKTDDQQESINDQESLKVDESCKKSVTEDKADEEDVCPICLEEYDEENPRSITKCEHHFHLCCILEWMERKDTCPVCDQVWX

SEQ ID NO: 11593 - protein, 380 aa, Zea mays
  misc_feature (380)..(380): Xaa can be any naturally occurring amino acid
  unsure (1)..(380): unsure at all Xaa locations
VNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 11594 - protein, 582 aa, Zea mays
  misc_feature (582)..(582): Xaa can be any naturally occurring amino acid
  unsure (1)..(582): unsure at all Xaa locations
IDILSPPSHSIGFGGARGARATDDPRNEHRSVARKLHRVAGPGARGTAMAGAGAAANGGRNKYAVLDRSEERQTDARTERRRRPLAPESERGRRERFVYACAVFASLNAVLLGYDVGVMSGAIIYMQKDLHITEFQQEILVGCLSVVSLLGSLSGGRTSDAIGRKWTMGLGAIVFQIGATIMTFAPSFTVLMIGRLLAGVGIGFGAMVSGVYIAEISPAGARGTLTSLPEICINFGILLGYVSNYAFSGLSEHINWRIMLGVGILPSVFIGFALFVIPESPRWLMMEKRVSEARAVLLQISESEAEAEERLAEIEEAAGLMKSMKSEDKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQNHAVGLMSPRVGIDLAIFAVCGNVAFFSIGMGPICWVLSSEVFPLRLRAQGSALGQVGGRVSSGLVSMSFLSMARAISVAGMFFVFAAISTISVLFVYFCVPETKGKTLEQIEMMFESGDEWGGGEIELEDTQHLIPSIKKSVPLGX

SEQ ID NO: 11595 - protein, 318 aa, Zea mays
  misc_feature (318)..(318): Xaa can be any naturally occurring amino acid
  unsure (1)..(318): unsure at all Xaa locations
MAATVSSFPVVNMEKLETEERATAMEVIRDGCENWGFFELLNHGISHELMDEVERLTKAHYATFREAKFQEFAARTLEAGEKGADVKDVDWESTFFVRHLPASNLADLPDVDDRYRQVMEQFASEIRKLSERLLDLLCENLGLEPGYLKAAFAGSDGPTFGTKVSAYPPCPRPDLVDGLRAHTDAGGIVLLFQDDQVSGLQLLRGGEWVDVPPMRHAIVANVGDQLEVITNGRYKSVMHRVLTRPDGNRMSVASFYNPGADAVIFPAPALVGAAEEDRAEAAYPSFVFEDYMNLYVRHKFEAKEPRFEAMKSAIATAX

SEQ ID NO: 11596 - protein, 495 aa, Zea mays
  misc_feature (495)..(495): Xaa can be any naturally occurring amino acid
  unsure (1)..(495): unsure at all Xaa locations
SHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVCX

SEQ ID NO: 11597 - protein, 474 aa, Zea mays
  misc_feature (474)..(474): Xaa can be any naturally occurring amino acid
  unsure (1)..(474): unsure at all Xaa locations
MAATAVSVDEKLDKLRAEVAKLSQISENEKAGFISLVSRYLSGEAEQIEWSKIQTPTDEVVVPYDTLTSPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAVKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTITAKSGVKLEVPDGAVFENKDVNGPEDLX

SEQ ID NO: 11598 - protein, 474 aa, Zea mays
  misc_feature (474)..(474): Xaa can be any naturally occurring amino acid
  unsure (1)..(474): unsure at all Xaa locations
MATTAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDLX

SEQ ID NO: 11599 - protein, 331 aa, Zea mays
LVALNCGMLALGAIGGPLLSRLYFSKGGHRQWLSAWLETGGWPLLLVPVAASFGARRARDRGAPVLLTPPRILLAAAGLGVATGVDDFVYAYGLAYLPVSTSAILISTQLAFTVFFAFLVVRQRLTAASVNAVALLTVGAVVLGLHVSSDRPPGVTRGRYWLGFSLTLCAAALYGLVLPLVELAYRRAAGGGRAVTYALVVEMQLVMGFFATAFCTVGMVVNKDFQAIPREARQYELGEARYYMVLAWAAVLWQCFFLGAVGVIFCVHTLLAGILIAVFIPVTEVAAVIFLHEKFSSEKGVALALSLWGLASYSYGEWSQAKAKKEKKSEE

SEQ ID NO: 11600 - protein, 507 aa, Zea mays; identical to SEQ ID NO: 11243
  misc_feature (507)..(507): Xaa can be any naturally occurring amino acid
  unsure (1)..(507): unsure at all Xaa locations

SEQ ID NO: 11601 - protein, 634 aa, Zea mays
  misc_feature (634)..(634): Xaa can be any naturally occurring amino acid
  unsure (1)..(634): unsure at all Xaa locations
LPFPARGATCAAATMPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLERYPTFVDALRDLDDCLTMVHLFAALPAVDGERVEVKRIHNCRRLSHEWQAYISRTHSLRKTFISVKGIYYQAEVQGQKITWLTPHALQQVLTDDVDFNVMLSFLEFYETLLGFVNFKLYHSINVNYPPILDPRLEALAAELYALCRYMSAGSRRMIGNSQTDEVMEDKDEKSKAEEVIKEEKVVKNKASSKADESELRLAQLQHQLPTNEPGALMNLVEESTADDADDDDTKDCKGLFKNLKFYLSREVPRESLLFIIPAFGGTVSWEGEGAPFKEIDEDITHQIVDRPTQSHVFLSRDYVQPQWVFDCVNARIILPTEGYLVGRVPPPHLSPFVDNDAEGYMPEYAETIKRLQAAARNEVLPLPGIGDEDLDNSLVAAMMDRTASNEAAEKKRKLEMLEKQYIDELKKEIDGVAFSSLSNKEADKSPNAKDDTQSDREEDASKQEEDDDDDIGTALMSRKQRGLYKAMKMGKEKKKEKVELLKKRKKNADSGASSKKRHX

SEQ ID NO: 11602 - protein, 474 aa, Zea mays; identical to SEQ ID NO: 11598
  misc_feature (474)..(474): Xaa can be any naturally occurring amino acid
  unsure (1)..(474): unsure at all Xaa locations

SEQ ID NO: 11603 - protein, 218 aa, Zea mays
  misc_feature (218)..(218): Xaa can be any naturally occurring amino acid
  unsure (1)..(218): unsure at all Xaa locations
RKPHKNPRSPQPAAAHAAACTSGVKMSRHPEVKWAQRIDKVYITVQLPDAKDAKVNLEPDGVFTFSGSAGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMGMDDFEDDSDEEEVSKPQAAGHAAEAEKTESAEAKTESAQSSX

SEQ ID NO: 11604 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11605 - protein, 351 aa, Zea mays; identical to SEQ ID NO: 10139

SEQ ID NO: 11606 - protein, 331 aa, Zea mays; identical to SEQ ID NO: 10893
  misc_feature (331)..(331): Xaa can be any naturally occurring amino acid
  unsure (1)..(331): unsure at all Xaa locations

SEQ ID NO: 11607 - protein, 434 aa, Zea mays
  misc_feature (434)..(434): Xaa can be any naturally occurring amino acid
  unsure (1)..(434): unsure at all Xaa locations
MGVGAEPKDQAATAAGVPAEQDEAGGKEDKAAAVSCSICLDAVLAASGERSTARLHCGHEFHLDCIGSAFNAKGVMQCPNCRKIEKGNWLYANGSRSAHDVSMDEWAHDEDLYDVSYSDMPFRFHWCPFGRLTQLPSLFEEGESSPPVTFHDFMGQHVFTEQVAVSAAAGTTNPCPYVAYLHPLTPLTSLSSSHVPDRTMDRPAYHDHWNPMAGPSDVRSMQTMQPADFHHSHWAHVPHSYGQPNSNNEQPGIPFGARAVRVDGDSQRRASVVSPSYFSNGSGSRSRPPNVPPLMPQFMRAHGSISEQYQQNSSSSLFAGAHRSGGMRPAPTPLPENPTFTLFPPGSSGHSSMETDDAGGSRFYAWEGDRFAPYPLMPVDCETSWRTSQQQSHQSTSEPTSAPRRLFGQWLAVGRPSPSPEGSSYRQLHSPRMX

SEQ ID NO: 11608 - protein, 290 aa, Zea mays
  misc_feature (290)..(290): Xaa can be any naturally occurring amino acid
  unsure (1)..(290): unsure at all Xaa locations
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRSX

SEQ ID NO: 11609 - protein, 281 aa, Zea mays
AAWTREEDKAFENAVAASAAPPADGPPDDGWFTALVASVPARTAEEVRRHYEALVEDVAAIEAGRIPLPRYAGEESSAATPEGSGAAGPSTPKDGGGGSGHRREERKGGVGADAGKSCSKAEQERRKGVPWTEEEHRLFLLGLDKFGKGDWRSISRNFVISRTPTQVASHAQKYFIRLNSMNRDRRRSSIHDITSVTAGEVATAGAPITGGGPTAAGAMPMGPGGMKHHHPVPPMGMYGHAPMGHPVAGHMVAPAAVGTPVMFPPGHHSPYVLPVGYPAPP

SEQ ID NO: 11610 - protein, 285 aa, Zea mays
AAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 11611 - protein, 352 aa, Zea mays
  misc_feature (352)..(352): Xaa can be any naturally occurring amino acid
  unsure (1)..(352): unsure at all Xaa locations
MDQSFGNLGAGAGSSSGGSNSKAAAAAVSSSSFLQLPLSTASPAYYGAPLALLHHAAAAPSSSQQHQQQQHHHHYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGSX

SEQ ID NO: 11612 - protein, 595 aa, Zea mays; identical to SEQ ID NO: 11138

SEQ ID NO: 11613 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11614 - protein, 217 aa, Zea mays
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGSI

SEQ ID NO: 11615 - protein, 245 aa, Zea mays; identical to SEQ ID NO: 10657
  misc_feature (245)..(245): Xaa can be any naturally occurring amino acid
  unsure (1)..(245): unsure at all Xaa locations

SEQ ID NO: 11616 - protein, 351 aa, Zea mays; identical to SEQ ID NO: 10139

SEQ ID NO: 11617 - protein, 366 aa, Zea mays
  misc_feature (366)..(366): Xaa can be any naturally occurring amino acid
  unsure (1)..(366): unsure at all Xaa locations
LVASPLLIFAARAAAMAMASTYAPGGGARALAQGRCRVRGPAGLGFLGPSKAAGLPRPLALARRMSSPVAVGARLRCAASSSPAAARPATAPRFIQHKKEAFWFYRFLSIVYDHVINPGHWTEDMRDDALEPADLFSRHLTVVDVGGGTGFTTLGIVKHVNPENVTLLDQSPHQLDKARQKEALKGVTIMEGDAEDLPFPTDSFDRYISAGSIEYWPDPQRGIKEAYRVLRFGGLACVIGPVYPTFWLSRFFADMWMLFPKEEEYIEWFKKAGFRDVKLKRIGPKWYRGVRRHGLIMGCSVTGVKRERGDSPLELGPKAEDVSKPVNPITFLFRFLVGTICAAYYVLVPIYMWIKDQIVPKGMPIX

SEQ ID NO: 11618 - protein, 382 aa, Zea mays; identical to SEQ ID NO: 10686

SEQ ID NO: 11619 - protein, 857 aa, Zea mays
  misc_feature (857)..(857): Xaa can be any naturally occurring amino acid
  unsure (1)..(857): unsure at all Xaa locations
MAQQMASVHLNDTTVVDAKPLRTLTPMFPAPLGLHTFTPQNSPSVVCVTPFGPYGGGTELGMPAVPPMFAAPVPAAGAEPSQRQPHTANMNGGDTELGMPAVPPMFAAPAPAAGAEPNQGQPHTANMNGTAVNSSVTSLQTPSAATQESGKRKRGRPKRVPDTTVSSAPSAPLAPTISPVPSLPVVTPVPSAPQELNTIVSLTPSSDAPQESGKRKRGRPKRIQDVPVMVPLTSQGDSTSVIQTLPGSSVHESGTRRGRPKRLQDSSDIVTPIDSKDSESSPQPPIAAPAESGKRKRGRPKRIDGSVTPSSHSVFSIDDDAVDTMKRGRPRKIDTKLLQFPSLFSDDPRQTADNVLMMFDALRRRLMQMDDVKQAAKQQPNLKAGSIMNNAELRVNKDKRIGEVPGVEVGDMFYFRIEMCLVGLNSQSMAGIDYMSAKFGNEEDPVAISVVSAGVYDNTGDDPDVLVYTGHGMSGKDDQKLERGNLALERSLHRGNPIRVIRSVKDLTCPTGKIYIYDGLYKIKEAWVEKGKSGFNVFKHKLLREPGQPDGIAVWKKTEKWRENPSSRDHVILLDISYGVENNPVCLVNEVDDEKGPSRFTYTTNLTYGNSLSSMRKMQGCKCISVCLPGDNNCSCTHRNAGDLPYSASGILVSRMPVLYECGDSCTCSQNCRNRVVQKGTQIRFEVFKTGDRGWGLRSWDPIRAGTFICEYAGEIIDINRVNGEDDYIFETSPLEQNLRWNYAPELLGEPSLSDSNETPKQLPIVISAKRTGNIARFMNHSCSPNVFWQPVLYDHGDEGYPHIAFFAIKHIPPMTELTYDYGQNQRNSIQMGTHSGFRKSKSCLCWSPKCRGSFGX

SEQ ID NO: 11620 - protein, 269 aa, Zea mays
  misc_feature (269)..(269): Xaa can be any naturally occurring amino acid
  unsure (1)..(269): unsure at all Xaa locations
KIPFSQSPLPVPDLVHSHSRNPAAPRLMASCGAGDAASAQPRASISHVIFDMDGLLLDTEGFYTEVQEKILARYDKVFDWSLKAKMMGKKAAESARIFVDECGLNGLLTPEQFLEERESMLQALFPSCTKLPGVLRLVHHLHANGVPMAVATGSHKRHFALKTQNHQEMFSLMHHVVMGDDPEVKAGKPSPDIFLAAMRRFEGGVEPSKCLVFEDAPSGVAAAKNAGMSVVMVPDPRLDVSYHKGADQVLSSLLDFKPAEWGLPAFKEX

SEQ ID NO: 11621 - protein, 550 aa, Zea mays
  misc_feature (550)..(550): Xaa can be any naturally occurring amino acid
  unsure (1)..(550): unsure at all Xaa locations
PLLLSPALANARTTASSFVPFPSIPPRSAGMLGVGMAAAVLLGAVALVLADAAARRAHWWYREAAEAVLVGAVALVVVDAAARRAHGWYREAALGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGSX

SEQ ID NO: 11622 - protein, 257 aa, Zea mays; identical to SEQ ID NO: 10038
  misc_feature (257)..(257): Xaa can be any naturally occurring amino acid
  unsure (1)..(257): unsure at all Xaa locations

SEQ ID NO: 11623 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11624 - protein, 848 aa, Zea mays; identical to SEQ ID NO: 10952

SEQ ID NO: 11625 - protein, 435 aa, Zea mays
  misc_feature (435)..(435): Xaa can be any naturally occurring amino acid
  unsure (1)..(435): unsure at all Xaa locations
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTHRRQRITPRIALPPPTRTAYSRTTSFSQQSGVYSRSSSFDQQTSVYQQRSESLKQQQPAAPKGPDTYVSESALEDRILCPICMYKSKDLAFGCGHQTCYECGRDLERCPLCQQHITTRIRLYX

SEQ ID NO: 11626 - protein, 378 aa, Zea mays
  misc_feature (378)..(378): Xaa can be any naturally occurring amino acid
  unsure (1)..(378): unsure at all Xaa locations
MAQDEAVATQKTGNTTSPSKDYPTPSPYPDWSTMQAYYGPGVLPPTYFTPAIAPGHPPPYMWGPQPIMPPPFGTPYAAVYPHGGAYPHPLVPMMSTPMSVEPAKSANSKEKNSNKKLKEIDRTAVSAGSGNSKRTVSSIEDYSAEGSSDVNDQNVNETSRKRSSDGGPGAETTTGGNTECVLAPNHTLGNATILPQHCFSAPVIKPSATNVANSRAIGTALSPPPGVMVPVHNAVPSDLSVKDERELKREKRKQSNRESARRSRLRKQAETEELATQVESLAAENTSLRSEIGRLTESSEKLRLENSALMVKLKDTAEPSPSKAAASPSSPRASAENFLSMIDSANAPSVSRHTEHGGPRLRQLLDSSPATDVAAVSX

SEQ ID NO: 11627 - protein, 401 aa, Zea mays
  misc_feature (401)..(401): Xaa can be any naturally occurring amino acid
  unsure (1)..(401): unsure at all Xaa locations
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTACAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDEX

SEQ ID NO: 11628 - protein, 607 aa, Zea mays
  misc_feature (607)..(607): Xaa can be any naturally occurring amino acid
  unsure (1)..(607): unsure at all Xaa locations
NDLSGGIPAQLARCANLTLLNLAYNRLAGEVPDVLGELRSLQELIVSGNGLGGEFPRSILRCRNLSKLDLSYNAFRGDLPENICNGSRLQFLVLDHNEFSGGIPAGIGGCTRLLELQLGSNNLSGEIPAEIGKVKSLQIALNLSSNHFTGPLPRELGRLDKLVVLDLSRNEISGQIPGDMRGMLSLIEVNLSNNRLAGAIPVFGPFQKSAASSFSGNAELCGDPLTVDCGSSIYGSSYGTETDHRGISYRVALAVVGSCVLIFSLVSLLVALFMWRERQEKEEEEAKKKAEEVAVAAAAPQVVASAVFVESLQQAIDFQSCVKATFKDENEVGDGTFSTTYRAVMPSGTVVSVKKLKSVDRAVVQQRTKVVRELERLAHIGHENLVRPIGYVLYDDVALLLHQHLANGTLLQLLHDNGERRKADWPRLLSIAVDVAQGLAFLHQVATVHLDVCSGNVFLDSRYNALLGEVEISRLLDPTKGTASISAVAGSFGYIPPEYAYTMRVTVPGNVYSFGVVLLEILTSKLPAVDEAFGEGVDLVKWVHAAPARGETPEQIMDPRLSAVSFAWRRQMLAVLRVAMLCTERAPAKRPRMKKVVEMLQEARDSX

SEQ ID NO: 11629 - protein, 508 aa, Zea mays
  misc_feature (508)..(508): Xaa can be any naturally occurring amino acid
  unsure (1)..(508): unsure at all Xaa locations
ALVFTPSLAPAACRGEASALPGAGLGSSSARKMAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALREAFYRQNLPNVTNLLATVLVFLIVIYFQGFRVVLPVRSKNARGQQGSYPIKLFYTSNMPIILHSALITNLYFISQLLYRKYSGNFLVNLLGMWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGFX

SEQ ID NO: 11630 - protein, 255 aa, Zea mays
  misc_feature (255)..(255): Xaa can be any naturally occurring amino acid
  unsure (1)..(255): unsure at all Xaa locations
PSTPSRGPGGKRMGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPTDGAAHQCESLRSSSRKLRSDQVAAPAHRSQPTTGLTMVLHASSIELSHYFQFLLKFVLLAYAVLCLTELLHRWSNGSVLSLWSAX

SEQ ID NO: 11631 - protein, 249 aa, Zea mays
  misc_feature (249)..(249): Xaa can be any naturally occurring amino acid
  unsure (1)..(249): unsure at all Xaa locations
SLLRQLHFLVDASVPPTMPAAMAAAAAQRLLAASTKIIGVGRNYIAHAKELGNPVPKEPVLFLKPTSSFLHAGVATAAVEIPEPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFSTX

SEQ ID NO: 11632 - protein, 474 aa, Zea mays
  misc_feature (474)..(474): Xaa can be any naturally occurring amino acid
  unsure (1)..(474): unsure at all Xaa locations
VGKTSLASSIAKALNRKFIRISLGGVKDEADIRGHRRTYIGSMPGRLIDGLKRVSVSNPVMLLDEIDKTGSDVRGDPASALLEVLDPEQNKAFNDHYLNVPFDLSKVIFVATANRMQPIPPPLLDRMEIIELPGYTPEEKLKIAMKHLIPRVLEQHGLSTTNLQIPEAMVKLVIERYTREAGVRNLERNLAALARAAAVKVAEQVKTLRLGKEIQPITTTLLDSRLADGGEVEMEVIPMEHDISNTYENPSPMIVDEAMLEKVLGPPRFDDREAADRVASPGVSVGLVWTSVGGEVQFVEATAMVGKGDLHLTGQLGDVIKESAQLALTWVRARAADLNLSPTSDINLLESRDIHIHFPAGAVPKDGPSAGVTLVTALVSLFSNRKVRADTAMTGEMTLRGLVLPVGGVKDKVLAAHRYGIKRVILPERNLKDLSEVPLPILSDMEILLVKRIEEVLDHAFEGRCPLRSRSKLX

SEQ ID NO: 11633 - protein, 481 aa, Zea mays
  misc_feature (481)..(481): Xaa can be any naturally occurring amino acid
  unsure (1)..(481): unsure at all Xaa locations
AGHPGACTGDGSMDKSAVAAYDVERGDYEEEHERRGTVWTATAHIVTAVIGSGVLALAWSVAQLGWVAGTLALAGFACVTYYTSTLLANAYRAPHPVTGDRNRTYMDAVRSYLSPREVFMCGIAQYVNLWGTMVGYTITATISMAAIRQSNCFRRSGAGAQCDAPGTVLMLAFGVVQVVLSQFPGLEHITWLSVVAAVMSFAYSFIGLGLSVGQWVSHGGGLGGRIAGAAAASPTRKLWNVLLALGNIAFAYTFAEVLIEIQDTLKSPPPENRTMKKAAMYGIGATTIFYISVGCAGYAAFGSDAPGNILTAGGLGPFWLVDIANMCLILHLIGAYQVYAQPIFASVERWAASRWPEAKFISSAYTVSIPLMQRGSVTVAPYKLVLRTVLVAATTVVALMIPFFNAVLGLLGAFSFWPLTVYFPISMHIAQDKITRGTKWYLLQALSMVCLMISVAVGIGSVTDIVDSLKVSSNPLKTVSX

SEQ ID NO: 11634 - protein, 289 aa, Zea mays
  misc_feature (289)..(289): Xaa can be any naturally occurring amino acid
  unsure (1)..(289): unsure at all Xaa locations
MPLAAVKYSRGTFIFPGAQPAPHRSFSEEVAALNRYFGGLKSGGNAYVIGDPARPGQKWHVFYATEYPEQPMVNLEMCMTGLDKKKASVFFKTNADGNTACAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDEX

SEQ ID NO: 11635 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11636 - protein, 631 aa, Zea mays
  misc_feature (631)..(631): Xaa can be any naturally occurring amino acid
  unsure (1)..(631): unsure at all Xaa locations
GSDPAAKRRLALRPLPQAPTMGAGATARDEETATGRHHGRKPHGAAAEYAQDGSVDLRGNPVLRSQRGGWTACSFIVVYELFERMAYYGISSNLIIYLTDRLHQGTVEASNNVTNWSGTVFLTPLLGAYVADAYLGRYWTFVVGSAIYLLGMVLLVLSVSVPALKPPPCGAGGVCPQASALQLGAYFGGLYIVALGNGGTKPNISTIGADQFDEFDPRERTHKLSFFNWWMFTIFLGILFSSTVLVYLQDNVSWSVGYGIPTLGLMVSISVFLAGTRLYRHRVPQGSPFTSMGRVLAAALWKWSVPVPADAKELHELDVEEYARKRKFRMDSTDAMAFLNKAAAVPSGGPAATPAWSLCTVTQVEETKQILRLVPLLVAMIVPCTLIAQTNTLFVKQGTTMDRHMGPRFEIPAASLGAFVTLTMLVAVVVYDRVFVRAVRRYTKDPRGITILRRMGTGMLLQVATMAVASAIESRRLAYARSHGLDATGGQLGLTIFALLPQFVLMGLADAFLVVGKIEFFYDQAPESMKSLGTAMSLTAYGIGNFLSSFLLSTVTRVTRDRGHAWVTNNLNASNLDYYYAFLTALGVVNFVAFLALSARYRYKAQSTDTIDAAVGLETEKAKLQAEPLGX

SEQ ID NO: 11637 - protein, 380 aa, Zea mays; identical to SEQ ID NO: 10029
  misc_feature (380)..(380): Xaa can be any naturally occurring amino acid
  unsure (1)..(380): unsure at all Xaa locations

SEQ ID NO: 11638 - protein, 133 aa, Zea mays; identical to SEQ ID NO: 11305
  misc_feature (133)..(133): Xaa can be any naturally occurring amino acid
  unsure (1)..(133): unsure at all Xaa locations

SEQ ID NO: 11639 - protein, 1136 aa, Zea mays
  misc_feature (1136)..(1136): Xaa can be any naturally occurring amino acid
  unsure (1)..(1136): unsure at all Xaa locations
MSLPSNNRRTCSRSSSARSKHSARVVAQTPVDAQLHAEFEGSQRHFDYSSSVGAANRPSASTSTVSTYLQNMQRGRYIQPFGCLLAVHPDTFALLAYSENAPEMLDLTPHAVPTIDQRDALGIGVDVRTLFRSQSSIALHKAAAFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVISECRRSDLEPYLGLHYPATDIPQASRFLFMKNKVRMICDCCATPVKVIQDDSLAQPLSLCGSTLRASHGCHAQYMANMGSVASLAMSVTINEDEEEDGDTGSDQQPKGRKLWGLVVCHHTSPRFVPFPLRYACEFLLQVFGIQLNKEVELAAQAKERHILRTQTLLCDMLLRDAPVGIFTRSPNVMDLVKCDGAALYYQNQLLVLGSTPSESEIKSIATWLQDNHDGSTGLSTDSLVEAGYPGAVALREVVCGMAAIKISSKDFIFWFRSHTTKEIKWGGAKHEPVDADDDGRRMHPRSSFKAFLEVVKWRSVPWEDVEMDAIHSLQLILRGSLPDEDANRNNVRSIVKAPSDDMKKIQGLLELRTVTNEMVRLIETATAPVLAVDIAGNINGWNNKAAELTGLPVMEAIGRPLIDLVVTDSIEVVKQILDSALQGIEEQNMEIKLKTFHEHECNGPVILKVNSCCSRDLSEKVIGVCFVAQDLTRQKMIMDKYTRIQGDYVAIVKNPSELIPPIFMINDLGSCLEWNKAMQKITGIKREDAINKLLIGEVFTLHDYGCRVKDHATLTKLSILMNAVISGQDPEKLFFGFFDTDGKYIESLLTVNKRTDAEGKITGALCFLHVASPELQHALQVQKMSEQAATNSFKELTYIRQELRNPLNGMQFTCNLLKPSELTEEQRQLLSSNVLCQDQLKKILHDTDLESIEQCYMEMNTVEFNLEQALNTVLMQGIPLGKEKRISIERNWPVEVSCMYLYGDNLRLQQILADYLACALQFTQTAEGPIVLQVMSKKENIGSGMQIAHLEFRIVHPAPGVPEALIQEMFQHNPGVSREGLGLYISQKLVKTMSGTVQYLREANTSSFIILMEFPVAQLSSKRSKPSTSKFX

SEQ ID NO: 11640 - protein, 587 aa, Zea mays
  misc_feature (587)..(587): Xaa can be any naturally occurring amino acid
  unsure (1)..(587): unsure at all Xaa locations
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFVX

SEQ ID NO: 11641 - protein, 228 aa, Zea mays
  misc_feature (228)..(228): Xaa can be any naturally occurring amino acid
  unsure (1)..(228): unsure at all Xaa locations
MIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFWAELLVEDFGDKAGQPELEGRTEDVNDLAQQLGYLSSSSPKX

SEQ ID NO: 11642 - protein, 505 aa, Zea mays
DLVKKHSEFISYPISLWTEKTTEKEISDDEDEEEKKDAEEGKVEDVDEKEEKEKKKKKIKEVSHEWSLVNKQKPIWMRKPEEITKEEYAAFYKSLTNDWEEHLAVKHFSVEGQLEFKAVLFVPKRAPFDLFDTKKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETALLTSGFSLDDPNTFGNRIHRMLKLGLSIDEDEPVEAEAEMPQLEDDAGESKMEEVD

SEQ ID NO: 11643 - protein, 223 aa, Zea mays
  misc_feature (223)..(223): Xaa can be any naturally occurring amino acid
  unsure (1)..(223): unsure at all Xaa locations
KNPRSPQPAAAHAAACTSGVKMSRHPEVKWAQRIDKVYITVQLPDAKDAKVNLEPDGVFTFSGSVGTNLYELKLDLNDKVNVEASKISVGVRSIFCIVEKAEAKWWKKLVRDDQRAPHFVKVDWDKWVDEDDDGADVNLDGMDFSNFGGMGGMGGMGGMGDMAGLGGLGGMGGMGGMGGMGMDDFEDDSDEEEVSKPQAAGHAAEAEKTESAEAKTESAQSSX

SEQ ID NO: 11644 - protein, 302 aa, Zea mays
  misc_feature (302)..(302): Xaa can be any naturally occurring amino acid
  unsure (1)..(302): unsure at all Xaa locations
PPSPPPPGMGGAQFPGDNDVAEVDAARDGEVDRRDVGKMKHGCEHYRRRCKIVAPCCNQVFPCRHCHNEATASGDRHTICRQDVEKVVCLLCETKQPVSQVCISCGVNMGEYFCDICKFYDDDTDKGQYHCIDCGICRVGGKENFFHCVKCGSCYSVILRDNHQCVENSMRQNCPICYEYLFDSLQGTRVLNCGHTMHLTCFEEMVAHNKYTCPICSKTALDLTHHWEMLDQEIEATIMPLVYRYKIWVLCNDCNKVSEVNFHVIGHKCSHCRSYNTRTTSRPADLSGSSSPSTDSSDNNIX

SEQ ID NO: 11645 - protein, 458 aa, Zea mays
  misc_feature (458)..(458): Xaa can be any naturally occurring amino acid
  unsure (1)..(458): unsure at all Xaa locations
SYMTCLNSNTGTSSDPKILAEASDGLERVKRVIDWVSLCKELIEKKTSPEATKALELISNALHICPYSDSLKEMKAETLLMLRRYEEVIQLCQESVNPTERKPALFKDNGEPKNSSLFEQTHFSGRYWRPYLICKSYFLSGKLDEAVELLKKHEQVTPVKESDVNTYQENFSSLSAIIRELLSLKAAGNESFQAGRYSDAVKQYSAALACNSESRAFSAVCFCNRAAAYQALGQVTDAIADCSLAMVLDTNYPKAISRRATLYEMIRDYGHAANDLRKLISLLEKKVNVSGISPKAFNKHKDIKQAHARLSHIHAEAKNDTPLNLYLILGVEPSCSSADIKKAYRKAALRHHPDKAAQLLVRNENAEDGFWRDVIKEVYADADHLFKTIGEAYNVLSDPDKRQEYDFEENLRNARRVSSSRSMRRSPEHNYSDRGFNPRQWQSSRASRWYSKSDDYWX

SEQ ID NO: 11646 - protein, 398 aa, Zea mays
  misc_feature (398)..(398): Xaa can be any naturally occurring amino acid
  unsure (1)..(398): unsure at all Xaa locations
RRFPSPAVESRNPSPASPPVVVAASAPAHSPPYLSSYAPSRCAVAPSIGPSFVGSVAAGSGSAGAMSKARVYTDVNVLRPKEYWDYEALTVQWGEQDNYEVVRKVGRGKYSEVFEGINVNNNEKCIIKILKPVKKKKIKREIKILQNLYGGPNIVKLLDIVRDQHSKTPSLIFEYVNNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNVYLNKYRIELDPQLEALVGRHSRKPWTKFINADNQHLVSHEAIDFLDKLLRYDHQDRLTAREAMTHPYFQQVRAAENSRTRAX

SEQ ID NO: 11647 - protein, 171 aa, Zea mays
AAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKA

SEQ ID NO: 11648 - protein, 362 aa, Zea mays
  misc_feature (362)..(362): Xaa can be any naturally occurring amino acid
  unsure (1)..(362): unsure at all Xaa locations
MCGGAILAELREPAPRRLTERDIWQQKKKPKRGGAGGRRSFAAEDDEDFEADFEDFEADSGDSDLELGEGADDDVIEIKPFAAKSTFSRDGLSTMTTAGYDAPAARLAKRKRKNQYRGIRQRPWGKWAAEIRDPQKGVRVWLGTFNSPEEAARAYDAEARRIRGKKAKVNFPDAPAVGQKCRSSSASAKALKSCVEQKPIVKTDMNILANTNAPFYQSVNYASNNPFVPAMNSTVSFEDPIMNLHSDQGSNSLGCSDLGWENDTKTPDITSIAPIPTIAEGDESVFVNSNSNSSMVPPVLENNAVDLTDGLTDLESYMRFLMDGGASDSIDSLLNLDGSQDLGSNMDLWTFDDMPIAGDFFX

SEQ ID NO: 11649 - protein, 429 aa, Zea mays; identical to SEQ ID NO: 11399
  misc_feature (429)..(429): Xaa can be any naturally occurring amino acid
  unsure (1)..(429): unsure at all Xaa locations

SEQ ID NO: 11650 - protein, 656 aa, Zea mays
  misc_feature (656)..(656): Xaa can be any naturally occurring amino acid
  unsure (1)..(656): unsure at all Xaa locations
MQGQRNSVEHFADVFGFDIASSSGNPVMDQQSYWNNVLGSVESQNLQGYQMNHSDAAMPYGNETQQDGTFLGFWESGEASASGSSNNAKTEHLSIGGGLRIGERRLVADNGISLDVDINLNANVNDLCGQSSNVNCTSQGPEHYGGGDRSVVNSQPTDLRLHPYRTFLLDAEQADSFTLNPSENPLCDFSLMQESIDQRPGSSLDGRRLACKRKNVEGPNGQSSAGASTSFSHRNDNAFHNIASSSYNPAPIRNPSSPNCLPVPSSIDDQLPRYGTNAGLSAGTYDLNGGVNNAGNSQRSFRARITTSQQIAPCSVWPSSNAIRLPNSWNHQPPHFQSAFDDTQEVIPVVSSLNLQYQHPVNVSSVPPAANRFTGHGASSSRAGSLENRILGSQEAPTRNVVPANYSDLVPPSVVDPRRLLPEPSNWSSDVRGTAISGSIPPVSRANNSATVNPPAGFSHQNLTRRHPRNLSEEIGRLSGALRGHQPPRLRPGFLLERQGDGVWGVPLSTRGREGRRLMEIRNALEMIHRGENVRLESIFYGGVDIHDRHRDMRLDIDNMSYEELLALEERIGNVGTGLSEEAVIRLLKQRKFSSWTLKASLDPEPCCICQEEYADGDDLGRLDCGHDFHAGCIKQWLVVKNVCPICKSTALKKTX

SEQ ID NO: 11651 - protein, 407 aa, Zea mays
EEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTR

SEQ ID NO: 11652 - protein, 694 aa, Zea mays
  misc_feature (694)..(694): Xaa can be any naturally occurring amino acid
  unsure (1)..(694): unsure at all Xaa locations
DRALWQAYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVHMEQLKTVLGLPETEAKVSELMEMYSGKGRVVMLGVDDMDIFKGISLKLLAMEELLRQHPEWRGKLVLVQVANPARGRGKDVAEVQTETYAMVRRINEAYGEPGYEPVVLIDEPLQFYERVAYYVIAEVCLVTAVRDGMNLIPYEYIVSRQGNEKLDRMLRQGKPEEKKSMLVVSEFIGCSPSLSGAIRVNPWNIEAVADAMETALVLPENEKRLRHDKHFRYVSTHDVGYWANSFLLDLERTCKYHSQKRCWGIGFGLRFRVVSLDLTFRKLSLENILMAYRRAKTRAILLDYDGTLMPQAINKSPSTESVRILNSLCRDKDNVVYLCSGYDRRTLHEWFPCENLGIAAEHGYFLRCKRDAEWKTCVAATDCSWKQIAEPVMCLYRETTDGSTIEDRETVLVWNYEDADPDFGSCQAKELVDHLESVLANEPVSVKTTPHSVEVKPQGVSKGLVARRMLVSMKERGQCPDFVLCIGDDKSDEDMFQLIATAACGDSLASKAEVFACTVGRKPSKAKYYLDDAAEVVRLMQGLSYVSEELALANQRDEDEDSSLDDVWEX

SEQ ID NO: 11653 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11654 - protein, 193 aa, Zea mays
AIAIAHALALFVGVSVAANISGGHLNPAVTFGLAVGGHITILTGVFYWVAQLLGATVACLLLGFVTHGKAIPTHAVAAGISELEGVVFEVVITFALVYTVYATAADPKKGSLGTIAPIAIGFIVGANILAAGPFSGGSMNPARSFGPAVAAGNFAGNWVYWVGPLVGGGLAGLVYGDVFIGGSYQQVADQDYA

SEQ ID NO: 11655 - protein, 168 aa, Zea mays; identical to SEQ ID NO: 10685

SEQ ID NO: 11656 - protein, 446 aa, Zea mays
  misc_feature (446)..(446): Xaa can be any naturally occurring amino acid
  unsure (1)..(446): unsure at all Xaa locations
MGQKDSKPSNGYGYSSDYGGTSSGYNLRNTGSTSSSYGARYVPSSENNVQPETHARLQRKYSRIGDDYRSLSQVTEALAQAGLESSNLIVGIDFTKSNEWTGKISFNRRCLHDIGNTPNPYEQAISIIGRTLSVFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATLDLQLLGRRQRITPRIALPPPTRTAYSRTTSFSQQSGVYSRSSSFDQQTSVYQQRSESLKQQQPAAPKGPDTYVSESALEDRILCPICMYKSKDLAFGCGHQTCYECGRDLERCPLCQQHITTRIRLYX

SEQ ID NO: 11657 - protein, 476 aa, Zea mays; identical to SEQ ID NO: 11372
  misc_feature (476)..(476): Xaa can be any naturally occurring amino acid
  unsure (1)..(476): unsure at all Xaa locations

SEQ ID NO: 11658 - protein, 644 aa, Zea mays
  misc_feature (644)..(644): Xaa can be any naturally occurring amino acid
  unsure (1)..(644): unsure at all Xaa locations
PHPTQPRTHAEEGESGCGGAAGRPRMFDDAGAVAVKRMRLWEEDEVEVEEEGMEVDAEPGWPWGTPAAGLSRAAAIVVADAADPDFPVIYVNAAFESATGYRAHEVLGRNCRFLQFRDPRAQRRHPLVDPMVVSEIRRCLNEGIEFQGELLNFRKDGAPLYNRLSLIPMHGDDGYVTHVIGIQLFSEANIDLSSVSYPVYKQQTNNRPIIQDLNSASHEHAPKVQSADHCGMLQLSDEVLAHNILSRLSPRDVASIGSVCTRMHELTKNDHLRKMVCQNAWGRDATVKLEMSTKMVGWGRLARELTTLEAASWRKFTVGGRVEPSRCNFSACAVGNRLVLFGGEGVNMQPMDDTFVLNMEAARPEWRRVKVSASPPGRWGHTLSWLNGSWLVVFGGCGQQGLLNDVFVLDLDAQQPTWREVASEGPPLPRSWHSSCTLDGSKLVVSGGCTESGVLLSDTFLLDLTKEKPAWREIPTSWSPPSRLGHTMSVYGTTKLLMFGGLAKSGSLRLRSSDAYTMDVGEDSPQWRQLATTGFPNVGPPPRLDHVAVSLPCGRIIIFGGSIAGLHSPAQLFLVDPAEEKPTWRILNVPGKPPKFAWGHSTCVVGGTRVLVLGGHTGEEWILNELHELCLASRPDDDDDDRYX

SEQ ID NO: 11659 - protein, 367 aa, Zea mays
  misc_feature (367)..(367): Xaa can be any naturally occurring amino acid
  unsure (1)..(367): unsure at all Xaa locations
VNFTALREIKLLKELKGPNIIELIDCFPYKENLHLVFEFMETDLEALIKDKNIILSPADTKSYLQMLLKGLSFCHKKWVIHRDMKPNNLLIGADGQLKLADFGLARMFGSPGRNFTHQVFARWYRAPELLFGSKQYGSGVDIWAAGCIFAELLTRRAFLQGSSDIDQLGKIFAALGTPKSSQWPDMVYLPDYVEYQYVAAPPLRTLLPMASDDALDLLSKMLTYDPKARISAQQALEHRYFSSLPAPTRPSQLLRSRWKGDQGNNKMPDLNLQHGPLVLSPPRKLRRVIAHEWMEGMHRADKVDEHPSGMRHTDDMPSQKSSRIPMSVDVGAVFGTRPAPRPTLNSADKSRLKRKLDMDPEFGFAEX

SEQ ID NO: 11660 - protein, 197 aa, Zea mays
  misc_feature (197)..(197): Xaa can be any naturally occurring amino acid
  unsure (1)..(197): unsure at all Xaa locations
MSRHPEVKWAQRIDKVYITVQLPDAKDAKVNLDPDGVFTFSGSAGTNLYELKLDLNDKVNVEASKISVGVRSIFCIVEKAEAKWWKKLVRDDQRAPHFVKVDWDKWVDEDDDGADINMDGMDFSNFGGMGGMGDMGGLGGMGGMGGLGGMGGMGMDDFEDESDDEEEVSKPQAADKAVEAEETESAETKTEAAQSSX

SEQ ID NO: 11661 - protein, 282 aa, Zea mays; identical to SEQ ID NO: 11394
  misc_feature (282)..(282): Xaa can be any naturally occurring amino acid
  unsure (1)..(282): unsure at all Xaa locations

SEQ ID NO: 11662 - protein, 239 aa, Zea mays
  misc_feature (239)..(239): Xaa can be any naturally occurring amino acid
  unsure (1)..(239): unsure at all Xaa locations
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTAARPSNKGGATLPCEENAVAKWSNNKLPPSAGATSPSGRRANLAGVAMRQVLHSSSVEISQYLPLLLKLVVLAYAALCLGELLHRWSSGGSCSLSPWCAX

SEQ ID NO: 11663 - protein, 262 aa, Zea mays; identical to SEQ ID NO: 10208
  misc_feature (262)..(262): Xaa can be any naturally occurring amino acid
  unsure (1)..(262): unsure at all Xaa locations

SEQ ID NO: 11664 - protein, 172 aa, Zea mays
  misc_feature (172)..(172): Xaa can be any naturally occurring amino acid
  unsure (1)..(172): unsure at all Xaa locations
GIGLSRTYLLYYTLGSKDTTAMAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLQQQLPFMFNPMAMTIPPMFLQQPFVGAAFX

SEQ ID NO: 11665 - protein, 188 aa, Zea mays
  misc_feature (188)..(188): Xaa can be any naturally occurring amino acid
  unsure (1)..(188): unsure at all Xaa locations
RAYHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11666 - protein, 158 aa, Zea mays; identical to SEQ ID NO: 10945
  misc_feature (158)..(158): Xaa can be any naturally occurring amino acid
  unsure (1)..(158): unsure at all Xaa locations

SEQ ID NO: 11667 - protein, 406 aa, Zea mays
  misc_feature (406)..(406): Xaa can be any naturally occurring amino acid
  unsure (1)..(406): unsure at all Xaa locations
MHDLVVSSNFLEQEGVSSSACSALFYFTPSALELEPSPSPQTQASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFNX

SEQ ID NO: 11668 - protein, 240 aa, Zea mays
  misc_feature (240)..(240): Xaa can be any naturally occurring amino acid
  unsure (1)..(240): unsure at all Xaa locations
RDQSLQRFELPYLSSALTLLPPTPDHKNPRSPQPAAAHAAACTSGVKMSRHPEVKWAQRIDKVYITVQLPDAKDAKVNLEPDGVFTFSGSAGTNLYELKLDLNDKVNVEASKISVGVRSIFCIVEKAEAKWWKKLVRDDQRAPHFVKVDWDKWVDEDDDGADVNLDGMDFSNFGGMGGMGGMGDMAGLGGLGGMGGMGMDDFEDDSDEEEVSKPQAAGHAAEAEKTESAEAKTESAQSSX

SEQ ID NO: 11669 - protein, 174 aa, Zea mays
  misc_feature (174)..(174): Xaa can be any naturally occurring amino acid
  unsure (1)..(174): unsure at all Xaa locations
PAGIGLSRTYLLYYTLGSKDTTAMAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLQQQLPFMFNPMAMTIPPMFLQQPFVGAAFX

SEQ ID NO: 11670 - protein, 151 aa, Zea mays
  misc_feature (151)..(151): Xaa can be any naturally occurring amino acid
  unsure (1)..(151): unsure at all Xaa locations
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHCDAVSQIMLQQQLPFMFNPMAMTIPPMFLQQPFVGAAFX

SEQ ID NO: 11671 - protein, 88 aa, Zea mays
EDIVPSSHNCDIPHVNRTEYQLIDISEDGFVSLLTSDGNTKDDLRLPTDETLVAQIKEGFESGKDLVVTVQSAMGEEQICALKDVGPK

SEQ ID NO: 11672 - protein, 380 aa, Zea mays; identical to SEQ ID NO: 10029
  misc_feature (380)..(380): Xaa can be any naturally occurring amino acid
  unsure (1)..(380): unsure at all Xaa locations

SEQ ID NO: 11673 - protein, 118 aa, Zea mays; identical to SEQ ID NO: 10884

SEQ ID NO: 11674 - protein, 189 aa, Zea mays
  misc_feature (189)..(189): Xaa can be any naturally occurring amino acid
  unsure (1)..(189): unsure at all Xaa locations
RDLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11675 - protein, 189 aa, Zea mays
  misc_feature (189)..(189): Xaa can be any naturally occurring amino acid
  unsure (1)..(189): unsure at all Xaa locations
GIAYHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11676 - protein, 189 aa, Zea mays; identical to SEQ ID NO: 11675
  misc_feature (189)..(189): Xaa can be any naturally occurring amino acid
  unsure (1)..(189): unsure at all Xaa locations

SEQ ID NO: 11677 - protein, 118 aa, Zea mays; identical to SEQ ID NO: 10001

SEQ ID NO: 11678 - protein, 189 aa, Zea mays; identical to SEQ ID NO: 11675
  misc_feature (189)..(189): Xaa can be any naturally occurring amino acid
  unsure (1)..(189): unsure at all Xaa locations

SEQ ID NO: 11679 - protein, 118 aa, Zea mays; identical to SEQ ID NO: 10001

SEQ ID NO: 11680 - protein, 118 aa, Zea mays; identical to SEQ ID NO: 10001

SEQ ID NO: 11681 - protein, 118 aa, Zea mays; identical to SEQ ID NO: 10884

SEQ ID NO: 11682 - protein, 196 aa, Zea mays
  misc_feature (196)..(196): Xaa can be any naturally occurring amino acid
  unsure (1)..(196): unsure at all Xaa locations
LEAGRGAYHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11683 - protein, 118 aa, Zea mays
QLVAAAVLAAALLLLAAGAGTASAAVSCGEVTSSVAPCLGYAMGSAASPSAACCSGVRSLNSRASSTADRQATCNCLKSMTGRLGGGVRMANAANIPGKCGVSVGVPISPTVDCTKIN

SEQ ID NO: 11684 - protein, 118 aa, Zea mays; identical to SEQ ID NO: 10884

SEQ ID NO: 11685 - protein, 234 aa, Zea mays
  misc_feature (234)..(234): Xaa can be any naturally occurring amino acid
  unsure (1)..(234): unsure at all Xaa locations
GPVSRSLLPIGSTPPRNWKLRCNLPYSSSAASNTADAAAAGGSLDVLLCSHLVSAQELFSMARVYVGNLDSRVTSGELEDEFRVFGVLRSVWIARKPPGFAFIDFDDRRDAEDAIRDLDGKNGWRVELSRNSSGRGGRDRYGGSESKCYECGETGHFARECRLRIGSGGLGSGRRLSRSRSRSRSRSRSRSRSRSPRYRRSPSYSRRSYSPRYRSPRRRSPSPARARSYSRSPX

SEQ ID NO: 11686 - protein, 118 aa, Zea mays; identical to SEQ ID NO: 10884

SEQ ID NO: 11687 - protein, 153 aa, Zea mays
MASAELSREENVYMAKLAEQAERYEEMVEFMEKVAKTVDSEELTVEEQNLLSVAYKNVIGARRASWRIISSIEQKEEGRGNEDRVTLIKDYRGKIETELTKICDGILKLLENHLVPSSTAPESKVFYLKMKGDYYRYLAEFKTGAERKDAAEN

SEQ ID NO: 11688 - protein, 104 aa, Zea mays
  misc_feature (104)..(104): Xaa can be any naturally occurring amino acid
  unsure (1)..(104): unsure at all Xaa locations
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGGX

SEQ ID NO: 11689 - protein, 118 aa, Zea mays
QLVAAAVLAAALLLLAAGAGTASAAVSCGEVTSSVAPCLGYAMGSAASPSTACCSGVRSLNSRASSAADRQATCNCLKSMTGRLGGGVSMANAANIPGKCGVSVGVPISPTVDCTKIN

SEQ ID NO: 11690 - protein, 189 aa, Zea mays
  misc_feature (189)..(189): Xaa can be any naturally occurring amino acid
  unsure (1)..(189): unsure at all Xaa locations
GIAYHLRLYISSLSAPPPPPDPSKTGIAMSDSEEHHFESKADAGASKTYPQQAGTVRKNGFIVIKNRPCKVVEVFTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11691 - protein, 189 aa, Zea mays; identical to SEQ ID NO: 11675
  misc_feature (189)..(189): Xaa can be any naturally occurring amino acid
  unsure (1)..(189): unsure at all Xaa locations

SEQ ID NO: 11692 - protein, 192 aa, Zea mays
  misc_feature (192)..(192): Xaa can be any naturally occurring amino acid
  unsure (1)..(192): unsure at all Xaa locations
PGAYPLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11693 - protein, 191 aa, Zea mays
  misc_feature (191)..(191): Xaa can be any naturally occurring amino acid
  unsure (1)..(191): unsure at all Xaa locations
GRDHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11694 - protein, 511 aa, Zea mays
  misc_feature (511)..(511): Xaa can be any naturally occurring amino acid
  unsure (1)..(511): unsure at all Xaa locations
MAQLAVRSLLLSLLLVSPVVASPGIVKLNSSSTLFGIEFPPFNTAVAATGCDSKLVAADEAGDEQKQPASSSPSLQLRMKHRSAEGGRTRKESFLDKAEKDAVRIETMHRRAARSGVARMPASSSPRRALSERMVATVESGVAVGSGEYLIDVYVGTPPRRFRMIMDTGSDLNWLQCAPCLDCFEQRGPVFDPAASSSYRNVTCGDQRCGLVAPPEAPRACRRPAEDSCPYYYWYGDQSNTTGDLALESFTVNLTAPGASRRVDGVVFGCGHRNRGLFHGAAGLLGLGRGPLSFASQLRAVYGHTFSYCLVEHGSDAGSKVVFGEDYLVLAHPQLKYTAFAPTSSPADTFYYVKLKGVLVGGELLNISSDTWDVGKDGSGGTIIDSGTTLSYFVEPAYQVIRQAFVDLMSRLYPLIPDFPVLNPCYNVSGVERPEVPELSLLFADGAVWDFPAENYFVRLDPDGIMCLAVRGTPRTGMSIIGNFQQQNFHVVYDLQNNRLGFAPRRCAEVX

SEQ ID NO: 11695 - protein, 250 aa, Zea mays
  misc_feature (250)..(250): Xaa can be any naturally occurring amino acid
  unsure (1)..(250): unsure at all Xaa locations
MDPSGGAFLPPLQQGSSSFPRSSSNASLARSGSGGGGVGAGRGTRGRKMMRRVCRGVITFIFAIAGLFLGAVTGGLIGLATESGLFRGTGIGAITGALVSIEVVDSSIRLWQARRSGIWSILYVLNVIYSLLTGRLVREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKLX

SEQ ID NO: 11696 - protein, 284 aa, Zea mays
TYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 11697 - protein, 443 aa, Zea mays
  misc_feature (443)..(443): Xaa can be any naturally occurring amino acid
  unsure (1)..(443): unsure at all Xaa locations
MASRNHNAAAPQLHHHNRAGVPALGKTKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEYIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICKX

SEQ ID NO: 11698 - protein, 118 aa, Zea mays; identical to SEQ ID NO: 10001

SEQ ID NO: 11699 - protein, 171 aa, Zea mays
  misc_feature (171)..(171): Xaa can be any naturally occurring amino acid
  unsure (1)..(171): unsure at all Xaa locations
PDHSSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDVSLLTSDGNTKDDLRLPTDETLVAQIKEGFESGKDLVVTVQSAMGEEQICALKDVGPKX

SEQ ID NO: 11700 - protein, 118 aa, Zea mays; identical to SEQ ID NO: 10001

SEQ ID NO: 11701 - protein, 217 aa, Zea mays
  misc_feature (217)..(217): Xaa can be any naturally occurring amino acid
  unsure (1)..(217): unsure at all Xaa locations
AGRESPIYPPSLRLLSGAARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11702 - protein, 158 aa, Zea mays; identical to SEQ ID NO: 9900
  misc_feature (158)..(158): Xaa can be any naturally occurring amino acid
  unsure (1)..(158): unsure at all Xaa locations

SEQ ID NO: 11703 - protein, 554 aa, Zea mays
  misc_feature (554)..(554): Xaa can be any naturally occurring amino acid
  unsure (1)..(554): unsure at all Xaa locations
MDGDFEMPPAGADDMMGDDEMGDFGGDEGPVMKVGEEKEVGKEGLKKKLLKEGEGWETPEVGDEVEVHYTGTLLDGTKFDSSRDRGEPFKFKLGQGQVIKGWDQGIKTMKKGENAIFTIPPELAYGASGSPPTIPPNATLQFDVELLSWTSVKDICKDGGIFKKILKEGEKWENPKDPDEVLVKYEACLEDGTVVSKSEGVEFTVKDGYFCPALAKAVKTMKKAEKVLLTVKPQYGFGEKGRPAAGEEGAVPPNASLLIDLELISWKTVTEIGDDKKILKKVLKEGEGYERPNEGAVVEVKIIGKLLDGAVFTKKGHDEELFKFKTDEEEVIAGLDRAVLNMKKGEVALVTIPPEYAFGSTESKQDLAVVPPNSTVIYEVELISFVKDKESWDLNNEEKIEAAGKKKEEGNALFKSGKYTRASKRYEKAAKYIEYDTSFSEDEKKQSKQLKISCNLNNAACKLKLKDYKEAAKLCTKVLELDSRNVKALYRRVQAYIQLADLELAEADIKKALEIDPDNRDVKLEYKILKEKIKEYNKKDAKFYSNMFAKMTKX

SEQ ID NO: 11704 - protein, 193 aa, Zea mays
  misc_feature (193)..(193): Xaa can be any naturally occurring amino acid
  unsure (1)..(193): unsure at all Xaa locations
SAGIAYHPRLYISSLSAPPPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11705 - protein, 185 aa, Zea mays
  misc_feature (185)..(185): Xaa can be any naturally occurring amino acid
  unsure (1)..(185): unsure at all Xaa locations
HLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGGEQICALKDVGPKX

SEQ ID NO: 11706 - protein, 194 aa, Zea mays
  misc_feature (194)..(194): Xaa can be any naturally occurring amino acid
  unsure (1)..(194): unsure at all Xaa locations
AGRGAYHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11707 - protein, 304 aa, Zea mays; identical to SEQ ID NO: 9957
  misc_feature (304)..(304): Xaa can be any naturally occurring amino acid
  unsure (1)..(304): unsure at all Xaa locations

SEQ ID NO: 11708 - protein, 407 aa, Zea mays
  misc_feature (407)..(407): Xaa can be any naturally occurring amino acid
  unsure (1)..(407): unsure at all Xaa locations
MNGASAGVGGEAPLVYKAWKGNNVFLLKGRFIFGPDARSLFITMFLIVAPVSIFCAFVAKELMDKFSYGLGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVFIIKIRNAEQITIWKAMTKTPASIALIIYTFIAVWFVGGLSVFHLYLMSTNQTTYENFRYRYDQRDNPYNKGVMENIKEIFFTTIPPSKNNFCGRVEQEHGLRPRPTNGFMSPNMGRAVGDIEMGRKPVAWDEPRMAAEIGDLGAGLSNLLEDKDGRFRTTSPDLSRDALAVGGGLEEHGSSAMNPGRSSWGVEAGRX

SEQ ID NO: 11709 - protein, 214 aa, Zea mays
  misc_feature (214)..(214): Xaa can be any naturally occurring amino acid
  unsure (1)..(214): unsure at all Xaa locations
PGPIYPPSLRLLSGAARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11710 - protein, 118 aa, Zea mays; identical to SEQ ID NO: 10001

SEQ ID NO: 11711 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11712 - protein, 245 aa, Zea mays; identical to SEQ ID NO: 10657
  misc_feature (245)..(245): Xaa can be any naturally occurring amino acid
  unsure (1)..(245): unsure at all Xaa locations

SEQ ID NO: 11713 - protein, 299 aa, Zea mays
  misc_feature (299)..(299): Xaa can be any naturally occurring amino acid
  unsure (1)..(299): unsure at all Xaa locations
LEAGRNQFHNPLASAAIVTGNNNCEMATVETSGTAIGSSGRWALHGKTALVTGGTRGIGRAVVEELAALGAAVHTCSRKAEELGERIKEWEARGFSVTGSVCDLSERDQRERLLREVADRFGGKLNILVNNVGTNIRKPTTEFTAEEYSFLMATNLESAYHLCQIARPLLKLSGSGSIIFISSVAGAIGIFSGTIYAMTKGAINQLTKNLACEWAKDNIRANSVAPWYITTSLTEGILANKNFEEQVVSRTPLGRVGEPGEVSALVAFLCMPGSTYISGQTIAVDGGMTVNGFYPPKPX

SEQ ID NO: 11714 - protein, 190 aa, Zea mays
  misc_feature (190)..(190): Xaa can be any naturally occurring amino acid
  unsure (1)..(190): unsure at all Xaa locations
KLIAYHPRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11715 - protein, 195 aa, Zea mays
  misc_feature (195)..(195): Xaa can be any naturally occurring amino acid
  unsure (1)..(195): unsure at all Xaa locations
RGRPGKLIAYHPRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11716 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11717 - protein, 372 aa, Zea mays; identical to SEQ ID NO: 11052
  misc_feature (372)..(372): Xaa can be any naturally occurring amino acid
  unsure (1)..(372): unsure at all Xaa locations

SEQ ID NO: 11718 - protein, 279 aa, Zea mays; identical to SEQ ID NO: 11137
  misc_feature (279)..(279): Xaa can be any naturally occurring amino acid
  unsure (1)..(279): unsure at all Xaa locations

SEQ ID NO: 11719 - protein, 513 aa, Zea mays
  misc_feature (513)..(513): Xaa can be any naturally occurring amino acid
  unsure (1)..(513): unsure at all Xaa locations
PGPSPPSLSFHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11720 - protein, 389 aa, Zea mays
  misc_feature (389)..(389): Xaa can be any naturally occurring amino acid
  unsure (1)..(389): unsure at all Xaa locations
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDSEAAEAKEGMFVKNYSYX

SEQ ID NO: 11721 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 11722 - protein, 158 aa, Zea mays
  misc_feature (158)..(158): Xaa can be any naturally occurring amino acid
  unsure (1)..(158): unsure at all Xaa locations
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPAKEEEEEDEEESDKSKSEVNDEDDEEGSEEDEDDDEX

SEQ ID NO: 11723 - protein, 194 aa, Zea mays
  misc_feature (194)..(194): Xaa can be any naturally occurring amino acid
  unsure (1)..(194): unsure at all Xaa locations
PGKLIAYHPRLYISSLSAPPPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11724 - protein, 186 aa, Zea mays
  misc_feature (186)..(186): Xaa can be any naturally occurring amino acid
  unsure (1)..(186): unsure at all Xaa locations
YHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11725 - protein, 215 aa, Zea mays
  misc_feature (215)..(215): Xaa can be any naturally occurring amino acid
  unsure (1)..(215): unsure at all Xaa locations
RESPIYPPSLRLLSGAARVPSSIRSAECTPPFPTPIESMAAEGEKKMITLKSSDGEEFEVEEAVAMESQTIRHMIEDDCAGNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11726 - protein, 211 aa, Zea mays
  misc_feature (211)..(211): Xaa can be any naturally occurring amino acid
  unsure (1)..(211): unsure at all Xaa locations
RDIPTLRLLSGAARVPSSIRSAECTPPFPTPIESMAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFEX

SEQ ID NO: 11727 - protein, 254 aa, Zea mays
  misc_feature (254)..(254): Xaa can be any naturally occurring amino acid
  unsure (1)..(254): unsure at all Xaa locations
GKSNQLSSPSPDSHLHSPPVHQPLPAMAAAAAQKLLEASTKIIGVGRNYIAHAEELGNPIPKEPVLFLKPTSSFLHAGVATAAVEIPEPLESLHHEVELAVFISRRGRDIPEASAMDFVGGYALALDMTARGLQSVAKSAGLPWTLAKGQDTFTPISAVVPKSSVTNPDDLELWLKVDDELRQKGSTSDMIFKIPFLISYISSIMTLMEGDVILTGTPEGVGPVRVGQKIKAGITDLIDVEFDVQRRNRSFSTX

SEQ ID NO: 11728 - protein, 189 aa, Zea mays; identical to SEQ ID NO: 11675
  misc_feature (189)..(189): Xaa can be any naturally occurring amino acid
  unsure (1)..(189): unsure at all Xaa locations

SEQ ID NO: 11729 - protein, 190 aa, Zea mays
  misc_feature (190)..(190): Xaa can be any naturally occurring amino acid
  unsure (1)..(190): unsure at all Xaa locations
RDHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11730 - protein, 384 aa, Zea mays
  misc_feature (384)..(384): Xaa can be any naturally occurring amino acid
  unsure (1)..(384): unsure at all Xaa locations
RDEVHCRVADSPTPLASRNLHSPESKLHSSPMMASQAMVPLRQLFVDGEWRPPAQGRRLPVVNPTTEAHIGEIPAGTAEDVDAAVAAARAALKRNPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKANX

SEQ ID NO: 11731 - protein, 158 aa, Zea mays; identical to SEQ ID NO: 11722
  misc_feature (158)..(158): Xaa can be any naturally occurring amino acid
  unsure (1)..(158): unsure at all Xaa locations

SEQ ID NO: 11732 - protein, 199 aa, Zea mays
  misc_feature (199)..(199): Xaa can be any naturally occurring amino acid
  unsure (1)..(199): unsure at all Xaa locations
MPVPLAPYPAPPAPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCSFVTSVGVSTQSILFQKRMQLTNNVFCCRRLPLFRCYSYCETTCVSHKKQKTNRRVSLYSDLTWCRAEAQQLSX

SEQ ID NO: 11733 - protein, 389 aa, Zea mays
  misc_feature (389)..(389): Xaa can be any naturally occurring amino acid
  unsure (1)..(389): unsure at all Xaa locations
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENSVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSYX

SEQ ID NO: 11734 - protein, 496 aa, Zea mays; identical to SEQ ID NO: 4917

SEQ ID NO: 11735 - protein, 232 aa, Zea mays
  misc_feature (232)..(232): Xaa can be any naturally occurring amino acid
  unsure (1)..(232): unsure at all Xaa locations
MPAAMAAAAAQRLLAASTKIIGVGRNYIAHAKELGNPVPKEPVLFLKPTSSFLHAGVATAAVEIPEPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFSTX

SEQ ID NO: 11736 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11737 - protein, 189 aa, Zea mays; identical to SEQ ID NO: 11674
  misc_feature (189)..(189): Xaa can be any naturally occurring amino acid
  unsure (1)..(189): unsure at all Xaa locations

SEQ ID NO: 11738 - protein, 541 aa, Zea mays
MATGVAPAPLPHVRVHHGGVGFTRSVDFAKVLSAPGAGTMRASSSRGRALVAKSSSTGSETMELEPSSEGSPLLVPRQKYCESTHQTRRRKTRTVMVGNVPLGSDHPIRIQTMTTSDTKDVAKTVEEVMRIADKGADLVRITVQGRKEADACFEIKNTLVQKNYNIPLVADIHFAPTVALRVAECFDKIRVNPGNFADRRAQFEKLEYTDDDYQKELEHIEKVFSPLVEKCKQYGRAMRIGTNHGSLSDRIMSYYGDSPRGMVESALEFARICRKLDFHNFVFSMKASNPVIMVQAYRLLVAEMYNLGWDYPLHLGVTEAGEGEDGRMKSAIGIGTLLMDGLGDTIRVSLTEPPEEEIDPCQRLANLGTQAANLQIGVAPFEEKHRRYFDFQRRSGQLPLQKEGEEVDYRNVLHRDGSVLMSVSLDQLKAPDLLYRSLAAKLVVGMPFKDLATVDSILLRELPPVEDAEARLALKRLVDISMGVLAPLSEQLTKPLPHAIVLVNLDELSSGAHKLLPEGTRLAVTLRGDESYEQLDILKDV

SEQ ID NO: 11739 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 11740 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 11741 - protein, 195 aa, Zea mays
  misc_feature (195)..(195): Xaa can be any naturally occurring amino acid
  unsure (1)..(195): unsure at all Xaa locations
RGRPGKLIAYHPRLYISSLSAPPPLPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11742 - protein, 158 aa, Zea mays; identical to SEQ ID NO: 9900
  misc_feature (158)..(158): Xaa can be any naturally occurring amino acid
  unsure (1)..(158): unsure at all Xaa locations

SEQ ID NO: 11743 - protein, 238 aa, Zea mays
  misc_feature (238)..(238): Xaa can be any naturally occurring amino acid
  unsure (1)..(238): unsure at all Xaa locations
MAAAVVDDAGMDAVQKRLMFEDECILVDEQDNVVGHESKYNCHLMEKIDSENLLHRAFSVFLFNSKYELLLQQRSATKVTFPLVWTNTCCSHPLYRESELIQENYLGVRNAAQRKLLDELGIPAEDAPVDQFTPLGRMLYKAPSDGKWGEHELDYLLFIVRDVKVQPNPDEVADVKYVNREELKELIRKADAGEDGVKISPWFRLVVDNFLMGWWDHVEEGTLGEAVDMETIHKLKEX

SEQ ID NO: 11744 - protein, 118 aa, Zea mays; identical to SEQ ID NO: 10001

SEQ ID NO: 11745 - protein, 197 aa, Zea mays
  misc_feature (197)..(197): Xaa can be any naturally occurring amino acid
  unsure (1)..(197): unsure at all Xaa locations
LEAGREKPAGKKKKNLALNAFLPSPKTSSDPRSAAAAMDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKAX

SEQ ID NO: 11746 - protein, 345 aa, Zea mays
  misc_feature (345)..(345): Xaa can be any naturally occurring amino acid
  unsure (1)..(345): unsure at all Xaa locations
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKSX

SEQ ID NO: 11747 - protein, 134 aa, Zea mays; identical to SEQ ID NO: 4963

SEQ ID NO: 11748 - protein, 190 aa, Zea mays
  misc_feature (190)..(190): Xaa can be any naturally occurring amino acid
  unsure (1)..(190): unsure at all Xaa locations
KLIAYHPRLYISSLSAPPPPPDPSKTGIAMSDSGEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11749 - protein, 186 aa, Zea mays
  misc_feature (186)..(186): Xaa can be any naturally occurring amino acid
  unsure (1)..(186): unsure at all Xaa locations
SSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11750 - protein, 370 aa, Zea mays; identical to SEQ ID NO: 10557
  misc_feature (370)..(370): Xaa can be any naturally occurring amino acid
  unsure (1)..(370): unsure at all Xaa locations

SEQ ID NO: 11751 - protein, 546 aa, Zea mays
  misc_feature (546)..(546): Xaa can be any naturally occurring amino acid
  unsure (1)..(546): unsure at all Xaa locations
PGDESLARDLLLLRLPRAACPRDEILSLLEPPPQPKKKPLNPQSMASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGTEYALVTERGDSLSRLVGVAVAADAASREVPVSVSEYMRPTPRSASAAFDFEEAATFLADEGLDYAPLVSDDGEVVDLITAKDVERIRSYPKLGKPSLGASGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYEKKAFX

SEQ ID NO: 11752 - protein, 118 aa, Zea mays; identical to SEQ ID NO: 10001

SEQ ID NO: 11753 - protein, 118 aa, Zea mays; identical to SEQ ID NO: 10001

SEQ ID NO: 11754 - protein, 195 aa, Zea mays
  misc_feature (195)..(195): Xaa can be any naturally occurring amino acid
  unsure (1)..(195): unsure at all Xaa locations
EAGRGAYHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11755 - protein, 133 aa, Zea mays
  misc_feature (133)..(133): Xaa can be any naturally occurring amino acid
  unsure (1)..(133): unsure at all Xaa locations
SRPAGSLWPLPDPDACCPGLRRRRALHQTRGDSKMPRATSDAKLLIQSLGKAYAATPTNLKVAYMGLVGSFPFNSFLSGVLSCIGTAVLAVCLRIQVNKDNKEFKDLPPERAFADFVLCNLVLHLVIMNFLGX

SEQ ID NO: 11756 - protein, 184 aa, Zea mays
MRIMIKGGVWKNTEDEILKAAVMKYGKNQWARISSLLVRKSAKQCKARWYEWLDPSIKKTEWTREEDEKLLHLAKLMPTQWRTIAPIVGRTPSQCLERYEKLLDAACAKDENYEANDDPRKLRPGEIDPNPESKPARPDPVDMDEDEKEMLSEARARLANTRGKKAKRKAREKQLEEARRLASL

SEQ ID NO: 11757 - protein, 498 aa, Zea mays
  misc_feature (498)..(498): Xaa can be any naturally occurring amino acid
  unsure (1)..(498): unsure at all Xaa locations
MAGAAAVETAAAAAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWIX

SEQ ID NO: 11758 - protein, 118 aa, Zea mays
QLVAAAVLAAALLLLAAGAGTASAAVSCGEVTSSVAPCLGYAMGSAASPSAACCSGVRSLNSRASSAADRQATCNCLKSMTGRLGGGVSMANAANIPGKCGVSVGVPISPTVDCTKID

SEQ ID NO: 11759 - protein, 118 aa, Zea mays; identical to SEQ ID NO: 10001

SEQ ID NO: 11760 - protein, 118 aa, Zea mays; identical to SEQ ID NO: 10001

SEQ ID NO: 11761 - protein, 351 aa, Zea mays
  misc_feature (351)..(351): Xaa can be any naturally occurring amino acid
  unsure (1)..(351): unsure at all Xaa locations
MDQSFGNLGAGAGSSSGGSNSKAAAAAVSSSSFLQLPLSTASPAYYGAPLALLHHAAAAPSSSQQQQQQHHHQYARHGAEMSAAEAEAIKAKIVAHPQYSALLAAYLDCQKVGAPPDVLERLTAMAAKLDARPPGRHEPRDPELDQFMEAYCNMLVKYREELTRPIDEAMEFLKRVEAQLDCISGGGGSSSARLSLADGKSEGVGSSEDDMDPNGRENDPPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGSX

SEQ ID NO: 11762 - protein, 391 aa, Zea mays
  misc_feature (391)..(391): Xaa can be any naturally occurring amino acid
  unsure (1)..(391): unsure at all Xaa locations
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGTX

SEQ ID NO: 11763 - protein, 193 aa, Zea mays; identical to SEQ ID NO: 11479
  misc_feature (193)..(193): Xaa can be any naturally occurring amino acid
  unsure (1)..(193): unsure at all Xaa locations

SEQ ID NO: 11764 - protein, 193 aa, Zea mays
  misc_feature (193)..(193): Xaa can be any naturally occurring amino acid
  unsure (1)..(193): unsure at all Xaa locations
SRPAGIAYHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVAVQSAMGEEQICALKDVGPKX

SEQ ID NO: 11765 - protein, 194 aa, Zea mays
  misc_feature (194)..(194): Xaa can be any naturally occurring amino acid
  unsure (1)..(194): unsure at all Xaa locations
LEAGRDHLSSPSAPLSISLLLRLLLDPAKPGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11766 - protein, 164 aa, Zea mays
  misc_feature (164)..(164): Xaa can be any naturally occurring amino acid
  unsure (1)..(164): unsure at all Xaa locations
MARVYVGNLDARVTSGELEDEFRVFGVLRSVWVARKPPGFAFIDFDDRRDAEDAIRDLDGKNGWKVELSRSTNGRGSRDRHGGSESKCYECGETGHFARECRLRIGSGGLGSGRRRSRSRSRSRSPRYRRSPSYNRRSYSPRYRSPRRRTPSPARGRSYSRSPX

SEQ ID NO: 11767 - protein, 218 aa, Zea mays; identical to SEQ ID NO: 11453
  misc_feature (218)..(218): Xaa can be any naturally occurring amino acid
  unsure (1)..(218): unsure at all Xaa locations

SEQ ID NO: 11768 - protein, 416 aa, Zea mays
  misc_feature (416)..(416): Xaa can be any naturally occurring amino acid
  unsure (1)..(416): unsure at all Xaa locations
MGQMISGDKSDEQTARDDGIIKNGREILFQAFNWESNKHNWWSILEEKVTDLAESGFTSVWLPPPTQSLSREGYLPQNLYCLDSCYGSLHELKLLLHKMSEHNVRAMADVVINHRIGTTQGSNGMYNRYDGIPVSWDEHAVTSCSGGKGNKSTGDNFDGVPNIDHTQPFVRKDIIEWLIWLRKSVGFQDFRFDFTKGYAAKFVKEYIEESKPLFAVGEYWDSCEYSPPDYRLNYNQDIHRQRIINWIDNTGGLCAAFDFTTKGILQEAVKGELWRLRDSEGKPPGVMGWWPSRSVTFIENHDTGSTQGHWPFPSDHIMEGYAYILTHPGIPTVFYDHFYDQGVPLHDEIAKLMQIRKCQDIHSRSSIKILEVGSDLYSAIIDDKLCMKIGDGSWCPSDPEWRLAVSGDRYAVWHKX

SEQ ID NO: 11769 - protein, 197 aa, Zea mays
  misc_feature (197)..(197): Xaa can be any naturally occurring amino acid
  unsure (1)..(197): unsure at all Xaa locations
SRPAGPGKLIAYHPRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11770 - protein, 402 aa, Zea mays
  misc_feature (402)..(402): Xaa can be any naturally occurring amino acid
  unsure (1)..(402): unsure at all Xaa locations
MSFRSLIQDMKDEFGSISRHSLRSRSHRSAGNAARAVAAGPSEAMDQSCWSQLPPELLREVLVRIEASESWWPARKDVVSGAGVCRTWRGIMKEAVRVPEVSGKLTFPISLKQPGPRDGTLKCFIRRNRTTQTYYLYIGLTEALADDGKFLLAARKCRKPTCTDYLISLDKVDMSKGSSTYIGKLRSNFLGTKFTVYDAHPPYDGAAVSKSRSARVVGLKQVSPRVPAGNYPVSHISYELNVLGSRGPRRMNCVMDSIPASAVKEGGKTPTQTEFPLSSLDSFPSFPFFRSKSARIDSSTSQSSSQREDRLVLKNKSPRWHEQLQCWCLNFRGRVTVASVKNFQLVASEDNGPESQESDKVILQFGKIGKDLFTMDYGYPISAFQAFAICLSSFDTKIACEX

SEQ ID NO: 11771 - protein, 262 aa, Zea mays
  misc_feature (262)..(262): Xaa can be any naturally occurring amino acid
  unsure (1)..(262): unsure at all Xaa locations
RPQRLASAALPLSRDPRDRNRGAPPPSSKMAPSLLGGFTKSLAMTVLSEIGDKTFFAAAILAMRHPRKLVLAGCLTALIVMTALSASLGWVAPNLISRKWTHHLTTLLFFLFGIWSLWEGFKEDGDSEELAEVEAELDAAFKSNKGESKNKFKANDDMKKQQRPFLMQFFSPIFLKAFSITFFGEWGDKSQIATIGLAADENPFGVVLGGIIAQALCTTAAVLGGKSLASQISEKMVELSSGVLFLLFGIMSLLSGPEGELX

SEQ ID NO: 11772 - protein, 596 aa, Oryza sativa; identical to SEQ ID NO: 10552
  misc_feature (596)..(596): Xaa can be any naturally occurring amino acid
  unsure (1)..(596): unsure at all Xaa locations

SEQ ID NO: 11773 - protein, 591 aa, Oryza sativa
  misc_feature (591)..(591): Xaa can be any naturally occurring amino acid
  unsure (1)..(591): unsure at all Xaa locations
RASSLARLSISISPSSSYVSAAPHFLHSISFLGLSSSDTGVCRFVFVRGASAMARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGHX

SEQ ID NO: 11774 - protein, 596 aa, Oryza sativa; identical to SEQ ID NO: 10552
  misc_feature (596)..(596): Xaa can be any naturally occurring amino acid
  unsure (1)..(596): unsure at all Xaa locations

SEQ ID NO: 11775 - protein, 812 aa, Oryza sativa
  misc_feature (812)..(812): Xaa can be any naturally occurring amino acid
  unsure (1)..(812): unsure at all Xaa locations
MRKWALSSALLLLLLLTTLPDPAKKLQVNADDSTDELVDPPKVEEKIGGVPHGLSTDSEVVQREAESISRKTLRSSAEKFEFQAEVSRLMDIIINSLYSNKDIFLRELISNASDALDKIRFLALTDKEVLGEGDTAKLEIQIKLDKEKKILSIRDRGIGMTKEDLIKNLGTIAKSGTSAFVEKMQTGGDLNLIGQFGVGFYSVYLVADYVEVISKHNDDKQHVWESKADGSFAISEDTWNEPLGRGTEIRLHLRDEAKEYVEEDKLKDLVKKYSEFINFPIYLWATKEVDVEVPADEDESSESSEEEESSPESTEEEETEESEEKKPKTKTVKETTTEWELLNDVKAIWLRSPKEVTEEEYTKFYHSLAKDFGDDKPLSWSHFTAEGDVEFKALLFVPPKAPHDLYESYYNSNKSNLKLYVRRVFISDEFDELLPKYLSFLKGLVDSDTLPLNVSREMLQQHSSLKTIKKKLIRKALDMIRKLAEEDPDEYSNKDKTDEEKSAMEEKKGQYAKFWNEFGKSVKLGIIEDATNRNRLAKLLRFESTKSEGKLASLDEYISRMKPGQKDIFYITGSSKEQLEKSPFLERLTKKNYEVIYFTDPVDEYLMQYLMDYEDKKFQNVSKEGLKLGKDSKLKDLKESFKELTDWWKKALDTESVDSVKISNRLSDTPCVVVTSKYGWSANMEKIMQSQTLSDASKQAYMRGKRVLEINPRHPIIKELRDKVAQDSESESLKQTAKLVYQTALMESGFNLPDPKDFASSIYRSVQKSLDLSPDAAVEEEEEVEEAEVEEKESSNIKEEAEPSSYDKDELX

SEQ ID NO: 11776 - protein, 493 aa, Oryza sativa
  misc_feature (493)..(493): Xaa can be any naturally occurring amino acid
  unsure (1)..(493): unsure at all Xaa locations
MVLSHGVSGSDESVHSTFASRYVRTSLPRFRMPEQSIPKEAAYQIINDELMLDGNPRLNLASFVTTWMEPECDKLIQASVNKNYVDMDEYPVTTELQNRCVNMIAHLFNAPLGDSETAVGVGTVGSSEAIMLAGLAFKRRWQNKMKAAGKPCDKPNIVTGANVQVCWEKFARYFEVELKEVKLSDGYYVMDPAKAVDMVDENTICVAAILGSTLNGEFEDVKLLNDLLTKKNAETGWDTPIHVDAASGGFIAPFLYPELEWDFRLPLVKSINVSGHKYGLVYAGIGWCIWRSKEDLPEELIFHINYLGADQPTFTLNFSKGSSQVIAQYYQLIRLGFEGYKNIMENCQENAMVLKQGLEKTGRFNIVSKDNGVPLVAFSLKDSARHNEFEISDFLRRFGWIVPAYTMPPDAQHVTVLRVVIREDFSRTLAERLVLDVEKVLHELDALPARVVANGGDAAAASASEREMEKQREVISLWKRAVLAKKKTNGVCX

SEQ ID NO: 11777 - protein, 120 aa, Oryza sativa
  misc_feature (120)..(120): Xaa can be any naturally occurring amino acid
  unsure (1)..(120): unsure at all Xaa locations
MSTTRGVSSSSAAAALALLLLFALCFFSFHFAAAARAVPRDEHQENGGVKAVAAVAADQLVLQLEGDTGNGDEVSELMGAAEEEAAACEEGKNNDECVQRRLLSDAHLDYIYTQHKNKPX

SEQ ID NO: 11778 - protein, 596 aa, Oryza sativa; identical to SEQ ID NO: 10552
  misc_feature (596)..(596): Xaa can be any naturally occurring amino acid
  unsure (1)..(596): unsure at all Xaa locations

SEQ ID NO: 11779 - protein, 201 aa, Oryza sativa
  misc_feature (201)..(201): Xaa can be any naturally occurring amino acid
  unsure (1)..(201): unsure at all Xaa locations
PNRHAGREERTTSHRARPNRRSCFPEEKNMSRHPSTKWAQRSDKVFLTIELPDARDVKLNLKPEGQFIFSAKGPADDTPYELDLELFDAVNVEESKAAVAARSICYLIKKAESKWWPRLLKKEGKPPVFLKVDWDKWQDEDDEDIGLGDFGDMDFSKLGMGGPDDDLEDDDEDDTADSANKDDEDIKAEGSGEAAGEAKPX

SEQ ID NO: 11780 - protein, 474 aa, Oryza sativa
  misc_feature (474)..(474): Xaa can be any naturally occurring amino acid
  unsure (1)..(474): unsure at all Xaa locations
MDQHQLDEENQRAALFHSSAPSSSLGADGEEERETVPLLSCKMADDKSDTVQVSEDTAHQISIDPWYQVGFILTTGVNSAYVLGYSASIMVPLGWIGGTCGLILAAAISMYANALLAHLHEVGGKRHIRYRDLAGHIYGRKMYSLTWALQYVNLFMINTGLIILAGQALKAIYVLFRDDGVLKLPYCIALSGFVCALFAFGIPYLSALRIWLGLSTVFSLIYIMIAFVMSLRDGITTPAKDYTIPGSHSDRIFTTIGAVANLVFAYNTGMLPEIQATIRPPVVKNMEKALWFQFTVGSLPLYAVTFMGYWAYGSSTSSYLLNSVKGPIWIKTVANLSAFLQTVIALHIFASPMYEFLDTRFGSGHGGPFAIHNIMFRVGVRGGYLTVNTLVAAMLPFLGDFMSLTGALSTFPLTFVLANHMYLTVKQNKMSIFRKCWHWLNVVGFSCLSVAAAVAAVRLITVDYSTYHLFADMX

SEQ ID NO: 11781 - protein, 262 aa, Oryza sativa
  misc_feature (262)..(262): Xaa can be any naturally occurring amino acid
  unsure (1)..(262): unsure at all Xaa locations
NPRLPRIAPPRPRRDRSRRRLPPPASSSAMAPSLLGGFTKSLAMTVLSEIGDKTFFAAAILAMRYPRKLVLAGCLTSLTVMTALSVSLGWVAPNLISRKWTHHVTTLLFFVFGILSLWEGFKEDGDSEELAEVEAELDANFKSNKAESKSKSKANDDKKKQQRPFVLQFFSPIFIKAFSITFFGEWGDKSQIATIGLAADENPFGVVLGGVLAQALCTTAAVMGGKSLASQISEKMVGLSSGVLFLLFGIMSYLSGPEGELX

SEQ ID NO: 11782 - protein, 326 aa, Oryza sativa
  misc_feature (326)..(326): Xaa can be any naturally occurring amino acid
  unsure (1)..(326): unsure at all Xaa locations
LRSLIASRLHYCGCIYYYTCSCIQSPPRVSTRSAAPSSLPTSATSERRRPPRAVRFREGGRRRPAAMVSPDTIRTAIGVVGNGTALVLFLSPVPTFIRIWKKGSVEQYSAVPYVATLLNCMMWVLYGLPAVHPHSMLVITINGTGMAIELTYIALFLAFSLGAVRRRVLLLLAAEVAFVAAVAALVLNLAHTHERRSMIVGILCVLFGTGMYAAPLSVMKMVIQTKSVEYMPLFLSLASLVNGICWTAYALIRFDLYITIPNGLGVMFAVAQLILYAIYYKSTQQIIEARKRKEADHVAMTDVVVDSAKNNPSSGAAAAAANGRYX

SEQ ID NO: 11783 - protein, 812 aa, Oryza sativa; identical to SEQ ID NO: 11775
  misc_feature (812)..(812): Xaa can be any naturally occurring amino acid
  unsure (1)..(812): unsure at all Xaa locations

SEQ ID NO: 11784 - protein, 442 aa, Oryza sativa
SAMNTSRAEEKAIDDWLPITSSRNAKWWYSAFHNVTAMVGAGVLSLPFAMSELGWGPGVAAMIMSWVITLYTLWQMVEMHECVPGRRFDRYHELGQHAFGDKLGLWIVVPQQLIVEVGVCIVYMVTGGKSLKKFHDLVAPPSAPPIRTSYFIVIFGCLHLVLSQLPNFNSITGVSLAAAVMSLSYSTIAWAASLHHHNHNNGAAAGGVDYSLTAATPAGRTFNFLSALGDVAFAYAGHNVVLEIQATIPSTPERPSKGPMWRGVVLAYGVVAVCYLPVAFAGYYVFGNAVDDNVLITLERPAWLIAAANIFVVVHVVGSYQIYAMPVFDMLETFLVKKLRFKPGMPLRLIARSLYVLFTMFVAIAVPFFGGLLGFFGGFAFAPTTYFLPCIMWLSIMKPKRFGLSWCINWFCIIIGVLLSVFAPIGGLRSIIVNAQSYKFFS

SEQ ID NO: 11785 - protein, 368 aa, Oryza sativa
  misc_feature (368)..(368): Xaa can be any naturally occurring amino acid
  unsure (1)..(368): unsure at all Xaa locations
MSSTAPLLTPYKMGRFDLSHRVVLAPLTRQRSYGNVPQPHAILYYQQRTTKGGLLIAEATGISDTAQGYKDTPGIWTKEQVEAWKPIVDGVHAKGGIFFCQIWHVGRVSNNTFQPNGQAPISSTNKSLKPAVRANGIDVATFSTPRRLETDEIPFVVNDYRVAARNAIEAGFDGVEIHGAHGYLIDQFLKDQVNDRSDKYGGSLENRCRFALEVVQAVTDEIGADKVGIRLSPFASYSEAADSNPEALGLYMANALNKFGILYCHMVEPRMVKLGEKFETPHSLRPIRDAFKGTFIAAGGYNKEDGNKAVSTGYTDLVAYGRLFLSNPDLPERFEIDAPLNKYNRETFYISDPVIGYTDYPFLPSDVX

SEQ ID NO: 11786 - protein, 502 aa, Oryza sativa
MASETETFAFQAEINQLLSLIINTFYSNKEIFLRELISNSSDALDKIRFESLTDKSKLDAQPELFIHIVPDKASNTLSIIDSGVGMTKSDLVNNLGTIARSGTKEFMEALAAGADVSMIGQFGVGFYSAYLVAERVVVTTKHNDDEQYVWESQAGGSFTVTRDTSGEQLGRGTKITLYLKDDQLEYLEERRLKDLVKKHSEFISYPISLWTEKTTEKEISDDEDEEEKKDAEEGKVEDVDEEKEEKEKKKKKIKEVSHEWNVMNKQKPIWLRKPEEITKEEYAAFYKSLTNDWEEHLAVKHFSVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYA

SEQ ID NO: 11787 - protein, 447 aa, Oryza sativa
  misc_feature (447)..(447): Xaa can be any naturally occurring amino acid
  unsure (1)..(447): unsure at all Xaa locations
ANRIDQLLPQVEAKSLAMSSPPPAAAAAMAVDDADDDQLASMSTEDIVRATRLLDNETRVLKDELQRTNLEVESYKEKIKENQEKIKLNKQLPYLVGNIVEILEMNPEDEAEEDGANIDLDSQRKGKCVVLKTSTRQIIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYAX

SEQ ID NO: 11788 - protein, 601 aa, Oryza sativa
  misc_feature (601)..(601): Xaa can be any naturally occurring amino acid
  unsure (1)..(601): unsure at all Xaa locations
TTSSSSSHPARASSLARLSISISPSSSYVSAAPHFLHSISFLGLSSSDTGVCRFVFVRGASAMARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSVSMGGGHX

SEQ ID NO: 11789 - protein, 952 aa, Oryza sativa; identical to SEQ ID NO: 11418
  misc_feature (952)..(952): Xaa can be any naturally occurring amino acid
  unsure (1)..(952): unsure at all Xaa locations

SEQ ID NO: 11790 - protein, 493 aa, Oryza sativa; identical to SEQ ID NO: 11776
  misc_feature (493)..(493): Xaa can be any naturally occurring amino acid
  unsure (1)..(493): unsure at all Xaa locations

SEQ ID NO: 11791 - protein, 340 aa, Oryza sativa
  misc_feature (340)..(340): Xaa can be any naturally occurring amino acid
  unsure (1)..(340): unsure at all Xaa locations
EDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYAX

SEQ ID NO: 11792 - protein, 391 aa, Oryza sativa
  misc_feature (391)..(391): Xaa can be any naturally occurring amino acid
  unsure (1)..(391): unsure at all Xaa locations
MSVLTCVLDNMGSSCSRSHSLSEAETTKNAKSADIDRRILQETKAEQHIHKLLLLGAGESGKSTIFKQIKLLFQTGFDEAELRSYTSVIHANVYQTIKILYEGAKELSQVESDSSKYVISPDNQEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGTX

SEQ ID NO: 11793 - protein, 263 aa, Oryza sativa; identical to SEQ ID NO: 10627
  misc_feature (263)..(263): Xaa can be any naturally occurring amino acid
  unsure (1)..(263): unsure at all Xaa locations

SEQ ID NO: 11794 - protein, 493 aa, Oryza sativa; identical to SEQ ID NO: 11776
  misc_feature (493)..(493): Xaa can be any naturally occurring amino acid
  unsure (1)..(493): unsure at all Xaa locations

SEQ ID NO: 11795 - protein, 812 aa, Oryza sativa; identical to SEQ ID NO: 11775
  misc_feature (812)..(812): Xaa can be any naturally occurring amino acid
  unsure (1)..(812): unsure at all Xaa locations

SEQ ID NO: 11796 - protein, 417 aa, Oryza sativa
  misc_feature (417)..(417): Xaa can be any naturally occurring amino acid
  unsure (1)..(417): unsure at all Xaa locations
MYVPQPSRSDAAGRDAGDQPRVYQVWRGSNEFFLRGRFIFGPDVRSIFLTMFLIVAPVVAFCVFVARHLIDDFPGDWGISVMVVVVVFTVYDLTLLLLTSGRDPGIIPRNTHPPEPEGFDGSNDSGVQTPQQLRLPRTKDVIVNGISVRIKYCDTCMLYRPPRCSHCSICNNCVERFDHHCPWVGQCIGLRNYRFFYMFVFSTTLLCLYVFAFCWVYIIKIRNAESLSVWKAMLKTPASIVLIIYCFLCVWFVGGLSVFHCYLMSTNQTTYENFRYRYDRRANPYNRGVLNNFLEIFCSRIPPSKNNFRARVTVEQGLQQTRVASRGFMSPNMGKPVGDLEMGRKPVPWDEPRTAADIRDLEAGLGGFLDEKEGRLTHASPDLSRDDLPADLMKGRAGTHSRRSSWVNRTGTSESEX

SEQ ID NO: 11797 - protein, 133 aa, Oryza sativa
  misc_feature (133)..(133): Xaa can be any naturally occurring amino acid
  unsure (1)..(133): unsure at all Xaa locations
LVAALLVLHSLATPSAQAEAHRAGGEGEEKMSSDGGPVLGGVEPVGNENDLHLVDLARFAVTEHNKKANSLLEFEKLVSVKQQVVAGTLYYFTIEVKEGDAKKLYEAKVWEKPWMDFKELQEFKPVDASANAX

SEQ ID NO: 11798 - protein, 484 aa, Oryza sativa
  misc_feature (484)..(484): Xaa can be any naturally occurring amino acid
  unsure (1)..(484): unsure at all Xaa locations
PSSSSSFSSSSSSSSSSSDIAAKEEEVDEGGGDQVIMGTQVADNYPPAKDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYSX

SEQ ID NO: 11799 - protein, 519 aa, Oryza sativa
  misc_feature (519)..(519): Xaa can be any naturally occurring amino acid
  unsure (1)..(519): unsure at all Xaa locations
MAGGAVVSTGAGKDYPGKLTLFVFFTCVVAATGGLIFGYDIGISGGVTSMDPFLRKFFPEVYRKKQMADKNNQYCKYDNQLLQTFTSSLYLAALVSSFFAATVTRVLGRKWSMFAGGLTFLIGAALNGAAENVAMLIVGRILLGVGVGFANQSVPVYLSEMAPARLRGMLNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGIGDIPKGYAAVVVLFICMYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKSHWFWRRFIGDHDVHVGANHVSNNKLQPX

SEQ ID NO: 11800 - protein, 719 aa, Oryza sativa
  misc_feature (719)..(719): Xaa can be any naturally occurring amino acid
  unsure (1)..(719): unsure at all Xaa locations
KDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWFX

SEQ ID NO: 11801 - protein, 519 aa, Oryza sativa; identical to SEQ ID NO: 11799
  misc_feature (519)..(519): Xaa can be any naturally occurring amino acid
  unsure (1)..(519): unsure at all Xaa locations

SEQ ID NO: 11802 - protein, 397 aa, Oryza sativa
SVEGQLEFKAILFVPKRAPFDLFDTRKKQNNIKLYVRRVFIMDNCEELIPEWLSFVKGIVDSEDLPLNISREMLQQNKILKVIRKNLVKKCVELFFEIAENKEDYNKFYEAFSKNLKLGIHEDSTNRTKIAELLRYHSTKSGDELTSLKDYVTRMKEGQSEIYYITGESKKAVENSPFLEKLKKKGYEVLYMVDAIDEYAVGQLKEFEGKKLVSATKEGLKLDESEDEKKRQEELKEKFEGLCKVIKEVLGDKVEKVVVSDRVVDSPCCLVTGEYGWTANMERIMKAQALRDSSMAGYMSSKKTMEINPENAIMDELRKRADADKNDKSVKDLVMLLFETALLTSGFSLEDPNTFGTRIHRMLKLGLSIDEDESAEADADMPPLEDDAGESKMEEVD

SEQ ID NO: 11803 - protein, 334 aa, Triticum aestivum
  misc_feature (334)..(334): Xaa can be any naturally occurring amino acid
  unsure (1)..(334): unsure at all Xaa locations
MAAQNNKEVDALVEKITGLHAAIAKLPSLSPSPAVDALFTELVTACVPPSPVDVTKLGPEAQEMREGLIRLCSEAEGKLEAHYSDMLAAFDNPLDHLGMFPYYSNYINLSKLEYELLARYVPGGIAPARVAFIGSGPLPFSSFVLAARHLPDTMFDNYDLCGTANDRASKLFRADTDVGARMSFHTADVADLAGELAKYDVVFLAALVGMAAEDKAKVIAHLGAHMADGAALVVRSAHGARGFLYPIVDPQDITLGGFEVLAVCHPDDDVVNSVIIAQKSKDVHVSGLHSGRAVGGQSARGTVPVVSPPCRFGEMVAEVTQKREEFANAEVAFX

SEQ ID NO: 11804 - protein, 247 aa, Zea mays
  misc_feature (247)..(247): Xaa can be any naturally occurring amino acid
  unsure (1)..(247): unsure at all Xaa locations
MKLEKRDVDVRGQKPNNVKVEKTTSNGSKAQSVKVERVSKEVIRTPDSKRPASVPNGHPKLTSLVKCNDPTRDKIRELLAEAFVSVSRETSDDDRDEVKNILDEVEACDPYRVAVTVESALFERLGPSTGTHRAKYRSIMFNLRAENNTDFRRRVLIGLVAPERLPDIPPDEMASDARKQENMQIKEKALFDCERGAAPKATTDQFKCARCGQRKTTYYQLQTRSADEPMTTFVTCVNCNNHWKFCX

SEQ ID NO: 11805 - protein, 434 aa, Zea mays
  misc_feature (434)..(434): Xaa can be any naturally occurring amino acid
  unsure (1)..(434): unsure at all Xaa locations
MGIPSDGDDVVQIRHADAAGEPTVVTVSCPDKTGLGCDLCRAVLLFGLSVVKGDMSTDGRWCYIVFWLLPRGRRPVAVPWDLLKDRLLQLCPVAPPFGFGSHDAYLAAAAGLQDVPPPAPQLFLLKLCCFDRMGLLHDVTRVLCELELTIRRVKVSTTPDGSVLDLFFITDARGLLHTKSRREETQDRLESVLGDSLTCCEIDPAGEDMVSCCLQSWAWASLTPAVIAQMFSTADRVEEQPIGTRGGGGGTIISVTMDNSLSPAHTLIQIQCGDHKGLLYDVMRIVKDCNIQISYGRFYASQNGRCEIDLFAVQSDGKKILDQHRQRALCCRLRMELRRPLHVALVNRGPDTELLVANPVEVSGKGRPLVFYDITLALKNLQRRIFLAEIGRHVVEGREWEVYRLHFGEEHELSSALRKKIVDAVTNMLMGWDX

SEQ ID NO: 11806 - protein, 209 aa, Zea mays
ADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKA

SEQ ID NO: 11807 - protein, 364 aa, Zea mays
  misc_feature (364)..(364): Xaa can be any naturally occurring amino acid
  unsure (1)..(364): unsure at all Xaa locations
WDCGKMPRDGAQAAPPPERGEMDEVVEADPDTEAEDQEERWARLLPELLSDVVRRVEASGGERWPARKDVVSCACVCRRWREAAVSVVRPPAESGKITFPSSLKQPGPRERPMQCFIKRNKNNSTFYLYLGFTSSPVDKGKFLMAARRFRRGPHTEYIISLDAEDLSQGSNAYMGKLRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSEPTTNVDDETVLLQFGKVDSDMFTMDYRQPLSAFQAFAISLSSFGTKLACEX

SEQ ID NO: 11808 - protein, 325 aa, Zea mays
  misc_feature (325)..(325): Xaa can be any naturally occurring amino acid
  unsure (1)..(325): unsure at all Xaa locations
HTAASRNHREPNRTGRRESREPGTVAWGRGAKMEGKEEDVRLGANKFSERQPIGTAAQGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRSX

SEQ ID NO: 11809 - protein, 746 aa, Zea mays
  misc_feature (746)..(746): Xaa can be any naturally occurring amino acid
  unsure (1)..(746): unsure at all Xaa locations
MSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGVLAIPSLFFFGLTIFYLPESPRWLVSKGRMAEAKKVLQKLRGKDDVSGELSLLLEGLEVGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKAX

SEQ ID NO: 11810 - protein, 746 aa, Zea mays; identical to SEQ ID NO: 11809
  misc_feature (746)..(746): Xaa can be any naturally occurring amino acid
  unsure (1)..(746): unsure at all Xaa locations

SEQ ID NO: 11811 - protein, 384 aa, Zea mays
  misc_feature (384)..(384): Xaa can be any naturally occurring amino acid
  unsure (1)..(384): unsure at all Xaa locations
VPPNTLTRVGLSISQSSLSSPLPSLHQVLPPADPNRNSVLRPQTTNPGSEVMGECEDGKEYRCWEELLPDALGLIFRNLPLQEVLTVLPRVCKSWGRVVAGPYCWQEIDIEEWSQQQGKPEQIARMVELLVGRSAGSCRRISVSGLPCDPRFSFIGDNARALRTLEIPRSEISDSMVESVAPRLPNVTFLDISSCTKMGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAGSDDDDDEAVWDDDGQGLENLEVRFYGGGFGETFAGFDWPPSPX

SEQ ID NO: 11812 - protein, 598 aa, Zea mays
  misc_feature (598)..(598): Xaa can be any naturally occurring amino acid
  unsure (1)..(598): unsure at all Xaa locations
KIKSKTIDVMPTKATLRSDNQEMSKEELRRQHQAELARQKNEETARRLAGVGTGSGDGRGPARASNELVAYKNVNDVPFVRDLVIQVDQKNEAVLLPIYGSMVPFHVSTVKSVTSHQDNRTCTIRIFFNVPGMPFSNDSKFNSQGAIYLKEITFRSKDPRHSSEVVQQIKTLRRQVASRESERAERATLVTQEKLQIGSNRMKMMRLSDVWIRPAFGGRGRKLTGNLEAHFNGFRYSTSRSDERVDIMFGNIKHAFFQPAEKEMITLLHFHLHNHIMVGNKKTKDVQFYVEVMDVVQTLGGSRRSALDPDEIEEEQRERDRKNRINMDFQNFVNKVNDHWSQPQFKGLDLEFDVPLRELGFHGVPYKASAFIIPTSTCLVELIETPFLVVSLSEIEIVNLERVGFGTKNFDMAIVFKDFKKDVLRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFRX

SEQ ID NO: 11813 - protein, 269 aa, Zea mays; identical to SEQ ID NO: 10272
  misc_feature (269)..(269): Xaa can be any naturally occurring amino acid
  unsure (1)..(269): unsure at all Xaa locations

SEQ ID NO: 11814 - protein, 763 aa, Zea mays; identical to SEQ ID NO: 9902
  misc_feature (763)..(763): Xaa can be any naturally occurring amino acid
  unsure (1)..(763): unsure at all Xaa locations

SEQ ID NO: 11815 - protein, 178 aa, Zea mays
EAEMDEDEDELGPGLGGGRAARSPCGLGEKKRRLALEQVRALERCFETDNKLDPDRKARIARDLALQPRQVAVWFQNRRARWKTKTLERDKDALAAEIRELRQKLLPKPEATVKLEATTGNDTAEERRQATAGAPPAGACKDGSSDSDSSVVFSDVEASPYSGGAAFEPPALAGLGAP

SEQ ID NO: 11816 - protein, 631 aa, Zea mays
  misc_feature (631)..(631): Xaa can be any naturally occurring amino acid
  unsure (1)..(631): unsure at all Xaa locations
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNAYKQASTLLALFAGGDGYRVEEKDGCLTLGWHTRPLIATSAWRVAAAAAPX

SEQ ID NO: 11817 - protein, 888 aa, Zea mays
  misc_feature (888)..(888): Xaa can be any naturally occurring amino acid
  unsure (1)..(888): unsure at all Xaa locations
MWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLENKTAFTTKKDYGREEREAQWATAQRTLHGLQPPEASSNTLFNDKSSYRELSEIAEQAKRRAEIARLRELNTLKGHVESVVKLKGLDIDTIQQNYTVX

SEQ ID NO: 11818 - protein, 184 aa, Zea mays; identical to SEQ ID NO: 10940
  misc_feature (184)..(184): Xaa can be any naturally occurring amino acid
  unsure (1)..(184): unsure at all Xaa locations

SEQ ID NO: 11819 - protein, 502 aa, Zea mays
  misc_feature (502)..(502): Xaa can be any naturally occurring amino acid
  unsure (1)..(502): unsure at all Xaa locations
FPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11820 - protein, 651 aa, Zea mays
  misc_feature (651)..(651): Xaa can be any naturally occurring amino acid
  unsure (1)..(651): unsure at all Xaa locations
MSRDLDCPVQTQMAVAVLDRSFSSEYPGGSRIEGRQLSWKRVFVQTDNGSVLGIELERGENVQTVKKKLQIALNVPTDESSLTFGDLVLNNDLSSIRNDSPLFLKRNQIHRSNSTPCLSPTGKNVLQRDRSGPIEILGCSSPSSRMKQLAKDVIKAIMNDVDPVAVNSGMGGAYYFKNIWGERVAIVKPTDEEPFAPNNPKGFVGKALGQPGLKRSVRVGETGFREVAAYLLDYGHFANVPPTMLVKITHTIFNVNDCVGCKSKVFCNKSEAVSKIASLQEFIPHDFDASDHGTSSFPVSAVHRIGILDIRIFNTDRHAGNLLVKKLGPGADNFGEQTELIPIDHGLCLPECLEDPYFEWIHWPQASVPFSEEELEYIARLDPVKDAEMLRMELPMIRDACLRVLVLSTVFLKEAAASGLCLSEIGDMMSRQFTAKEEEPSQLELLCMEARKWVEERESFLPNEAGVEDDDDDFTQFLIDGEDDYPDALEPSAFCKFGSMKASSRNPLSKLDERDEEDGDGTEEDDDDDILTGALPQRISSISKLSSSMKGLGFIGKPKPYRTCLRKGKATGRTKYTGKASEHQSGSRSANELLPPSASFVKLSDMSPKQWSAFLDKFQELLPGALSARKHAAGVVGQRSMPRLGTSCQFX

SEQ ID NO: 11821 - protein, 271 aa, Zea mays
  misc_feature (271)..(271): Xaa can be any naturally occurring amino acid
  unsure (1)..(271): unsure at all Xaa locations
MWGFASNAWAAGLEKRSSPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANYGGSPLLNAGRVQASLRKSLSFLVHLTAKFPLVFVFLLIVLYAIPASAAVLLLYILITVLFALPSFLILYFAYPSLDWLVREIFAX

SEQ ID NO: 11822 - protein, 612 aa, Zea mays
  misc_feature (612)..(612): Xaa can be any naturally occurring amino acid
  unsure (1)..(612): unsure at all Xaa locations
HRRRPSPPPGRPPDPTAPAAPMGRGGARAAPAAAVPPWHALPDEVWEHAFSFLPADSDRGAAACACHAWLRFERRSRRRLAVANCYAASPRDAVERFPAVRAVEVKGKPHFADFGLVPPAWGADAAPWVAAAAAGWPLLEEISFKRMVVTDDCLEMIAASFRNFQVLRLVSCEGFSTAGLAAIAAACRNLRELDLQENEIEDCSIHWLSLFPVSFTSLVTLNFSCLEGDVNITVLEQLVTRCSNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFEAAEQVSLTERGLVDVSASCPMLESVLYFCRRMTNEALITIAKNRPNFTCFRLCIIEPHTPDYITHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSMTLGACRQLARKMPRLSVEVMNDPRRGFPLDSLTDESPVETLYVYRTISGPRSDTPACVQILX

SEQ ID NO: 11823 - protein, 348 aa, Zea mays; identical to SEQ ID NO: 10155
  misc_feature (348)..(348): Xaa can be any naturally occurring amino acid
  unsure (1)..(348): unsure at all Xaa locations

SEQ ID NO: 11824 - protein, 434 aa, Zea mays
  misc_feature (434)..(434): Xaa can be any naturally occurring amino acid
  unsure (1)..(434): unsure at all Xaa locations
FDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 11825 - protein, 139 aa, Zea mays
  misc_feature (139)..(139): Xaa can be any naturally occurring amino acid
  unsure (1)..(139): unsure at all Xaa locations
MAEEKHHHHHLFHHKKDEEQLAAGGYGESAEYTEATVTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFGX

SEQ ID NO: 11826 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 11827 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 11828 - protein, 199 aa, Zea mays
EAEMDEDEDELGPGLGGGRAARSPCGLGEKKRRLALEQVRALERCFETDNKLDPDRKARIARDLALQPRQVAVWFQNRRARWKTKTLERDFAALRARHDALRADCDALRRDKDALAAEIRELRQKLLPKPEATVKLEATTGNDTAEERRQATAGAPPAGACKDGSSDSDSSVVFSDVEASPYSGGAAFEPPALAGLGAP

SEQ ID NO: 11829 - protein, 715 aa, Zea mays
  misc_feature (715)..(715): Xaa can be any naturally occurring amino acid
  unsure (1)..(715): unsure at all Xaa locations
QTLAASCKFQSSGICAMASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEKEEKEKKKKKIKEVSHEWSLVNKQKPIWMRKPEEITKEEYAAFYKSLTNDWEEHLAVKHFSVEGQLEFKAVLFVPKRAPFDLFDTKKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETALLTSGFSLDDPNTFGNRIHRMLKLGLSIDEDEPVEAEAEMPQLEDDAGESKMEEVDX

SEQ ID NO: 11830 - protein, 347 aa, Zea mays
  misc_feature (347)..(347): Xaa can be any naturally occurring amino acid
  unsure (1)..(347): unsure at all Xaa locations
MSNRATHWCYACQRPIRLRGQDIICPNCSDGFIQEISEMGGVLNTYGLTEPDFEERQARRFGMMDAISSLMRQRLSEIGRDSLFDIHGRQGTGTEYGRRSTAIPTLVFGGIPSPAVGSSDINVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHVPFSFLWPFGPSSSYQYEENVDEPAVYDPNQIAYSAWHYDHX

SEQ ID NO: 11831 - protein, 283 aa, Zea mays
  misc_feature (283)..(283): Xaa can be any naturally occurring amino acid
  unsure (1)..(283): unsure at all Xaa locations
AQFPDHTVPPSPGAAPRQEEVCSFNNMSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQX

SEQ ID NO: 11832 - protein, 194 aa, Zea mays
  misc_feature (194)..(194): Xaa can be any naturally occurring amino acid
  unsure (1)..(194): unsure at all Xaa locations
MIRDYGHAANDLRKLISLLEKKVNVSGISPKAFNKHKDIKQAHARLSHIHAEAKNDTPLNLYLILGVEPSCSSADIKKAYRKAALRHHPDKAAQLLVRNENAEDGFWRDVIKEVYADADHLFKTIGEAYNVLSDPDKRQEYDFEENLRNARRVSSSRSMRRSPEHNYSDRGFNPRQWQSSRASRWYSKSDDYWX

SEQ ID NO: 11833 - protein, 769 aa, Zea mays
  misc_feature (769)..(769): Xaa can be any naturally occurring amino acid
  unsure (1)..(769): unsure at all Xaa locations
MASLGDIGLAAGLNVLTAVAFLLAFAFLRLQPINDRVYFPKWYLRGMRDNPIVSGAAVQKFVNLDARSYLKFLNWMPAALKMPQDELINHAGLDSVVYLRIYVTGLKIFVPITVLAFLVLVPVNWTNDTLGRINVVYSPIDKLSISNVPNGSKRFIAHLGMAYAITFWTCYVLLKEYEIISNMRLRFLASEKRRPDQFTVLVRNIPPDPDESISELVEHFFLVNHPDHYLQHQVVYNANKLADLVEKKKKMRNWLDYYLLKYERNSSLRPTTKTGFLGCFGSKVDAIDYYKSEIEKIGKQEAEERKNVMKDPKSVVPAAFVSFRSRWGAAVCAQTQQTSNPTLWLTEWAPEPRDVYWNNLSIPFVSLTIRRLIVAVAFFFLNFFYVIPITFVQSLANLEGIEKALPFLKPLIDLPFIKSFIQGFLPGIALKIFLIVLPTILMFMSKFEGLISQSSLERRSASKYYIFLFFNVFLGSVIAGSALEQLKTYLHTSANDIPRIIGDSIPMKATFFITYVMVDGWTGIAGEILRLKPLIFFHLKNFFLVKTEKDREEAMDPGSICFDSTEPRIQLYFLLGLVYAAVTPFLLPFILVFFGFAYVVFRHQIINVYNQQYESAAQFWPSVHGRIITALIVSQLLLLGLMSTNDFEQTTPVLLVLPVLTFGFYKYCKNRFEPAFVRNPLQEAMKKDTLERAREPNLDLKAYLANSYLHPVFKGDEGDDRYSVMDDDGWMEEEVIVPTKRHSRRTTPAQSKHEGSDSLSVLESSLQRX

SEQ ID NO: 11834 - protein, 581 aa, Zea mays; identical to SEQ ID NO: 10846
  misc_feature (581)..(581): Xaa can be any naturally occurring amino acid
  unsure (1)..(581): unsure at all Xaa locations

SEQ ID NO: 11835 - protein, 424 aa, Zea mays
  misc_feature (424)..(424): Xaa can be any naturally occurring amino acid
  unsure (1)..(424): unsure at all Xaa locations
MERYSDMRPKAEVSYLGRGSRFSSRNQSSEERTNHSSDKPGSSTRFNPTKARIGGNQGRPRYVCDSFKSPSSKVSPAGSSKFPLSKFEERRRQPFVPGFDIAESSRRKADAKQLQGSKKIAAENDSSDNLRGESEGFTTEQVVKPEGSHVVGHSGVSAYTVGSLVQTASLGSRTHRQKHKEVNLGTPGASSSTLTNRSTIPGNSTMGVRPAYGHVNGGQIHGLKNLGCSSVPDAQPSGCPSESVISRRRFEFMRKRAFDQESSSRSVNLSLGHSTPTDIRRIRMNEQSLCQQIPRSSSRSHQESAGSVRTRRPSPHATRMSVPDGRADGVLSLHESSTKDVQPAQEHLSLEEVSTESSIRPFFVEFDNNIFSSSHLRRSSTRAERGRPSSLFEESPRQMFHSLMGERDRHRHITMEGITEVAFX

SEQ ID NO: 11836 - protein, 348 aa, Zea mays
  misc_feature (348)..(348): Xaa can be any naturally occurring amino acid
  unsure (1)..(348): unsure at all Xaa locations
PKWRLQLRPPLPFPTSSPSPPNPLPIPPPPLSLFLASWFVPHPPPHWVPRRDAMEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQSWPGVSCLPDFKTAFPRWQSQDLAIIVPNLEPAGLDLLSKMLRYEPSKRITARQALEHEYFKDLEMVQX

SEQ ID NO: 11837 - protein, 131 aa, Zea mays
  misc_feature (131)..(131): Xaa can be any naturally occurring amino acid
  unsure (1)..(131): unsure at all Xaa locations
MLDEAIDYLKSLQLQLQMLVMGKGMSPVVPLELQQYMHYITADPAQLPPLRPSGQQPRQFQITQANPQRQSNVESDFLSQMQNLHSSEPPQNFLRPPKLQLYTPEQRGGLPSTSHNTGWISGSSSYNFMEX

SEQ ID NO: 11838 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11839 - protein, 848 aa, Zea mays
SATEEASGAVSAVTVEKMLTVTASVQAAPAIGQMYFQRALDDAGDFFGKTLLMELVSSEVDAKTGLEKPRVTAFAHKTLREGHYEAEFKVPASFGPVGAVLLENEHHKEIFIREIKLVTGSDSSTAVTFGCNSWVHSKFDNPEKRIFFTLKSYLPSDTPKGLEDLRKKDLQALRGDGHGERKASERVYDYDVYNDLGDPDKNPAHQRPVLGGSKRYPYPRRCRTGRPRTRKDPEAEVRHGHNYVPRDEQFSEVKQLTFGATTLRSGLHALLPAIRPMLIKRELRFPHFPAIDDLYSDGIPLPAQTGLGAIRSIVPRVVKLVEDTTEHVLRFELPDMIERDRFSWFKDEEFARQTIAGLNPLCIQLLTEFPIRSKLDPEVYGPAESAITKEILEKHMSGGAAMTVEQALAAKRLFILDYHDVFLPYVHRVRELPDTTLYGSRTVFFLTDLGTLMPLAIELVRPKSPTQPQWKRVFTHGPDATDAWLWKLAKAHVVTHDTGYHQLVSHWLRMHCCVEPYIIAANRQLSRLHPVYRLLHPHFRYTMEINALAREALINADGIIEESFWPGRYAVELSSAAYGATWQFDTEALPNDLVKRGLAVRRDDGELELTIKDYPYAHDGLMVWNTIRQWAADYVNVYYKSDEAVAADPELKAFWDEVRNVGHGDKKDEPWWPVLDTRDSLAETLTTIMWVTSGHHSAVNFGQYHFGGYFPNRPTTIRKSMPVEEEAGRDEEMKKFLKQPETTLLDMLPTQMQAIRVMTTLDILSSHSPDEEYMGELAEPSWLEEPMVKAAFEKFGGRMKEIEGFIDECNNNPELRNRCGAGIVPYELLKPFSKPGVTGRGIPNSISI

SEQ ID NO: 11840 - protein, 721 aa, Zea mays; identical to SEQ ID NO: 10593
  misc_feature (721)..(721): Xaa can be any naturally occurring amino acid
  unsure (1)..(721): unsure at all Xaa locations

SEQ ID NO: 11841 - protein, 380 aa, Zea mays; identical to SEQ ID NO: 10225
  misc_feature (380)..(380): Xaa can be any naturally occurring amino acid
  unsure (1)..(380): unsure at all Xaa locations

SEQ ID NO: 11842 - protein, 502 aa, Zea mays
  misc_feature (502)..(502): Xaa can be any naturally occurring amino acid
  unsure (1)..(502): unsure at all Xaa locations
FPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11843 - protein, 508 aa, Zea mays
  misc_feature (508)..(508): Xaa can be any naturally occurring amino acid
  unsure (1)..(508): unsure at all Xaa locations
PSLSFHFPISQIQFASSPSSAAMALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYX

SEQ ID NO: 11844 - protein, 498 aa, Zea mays; identical to SEQ ID NO: 10968
  misc_feature (498)..(498): Xaa can be any naturally occurring amino acid
  unsure (1)..(498): unsure at all Xaa locations

SEQ ID NO: 11845 - protein, 495 aa, Zea mays
  misc_feature (495)..(495): Xaa can be any naturally occurring amino acid
  unsure (1)..(495): unsure at all Xaa locations
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGERYRSWDADRQDRFVRRFADSLGHPKVSQELRSIWIDLLAKCDASLGMKIATRLNMKPNMX

SEQ ID NO: 11846 - protein, 952 aa, Zea mays
  misc_feature (952)..(952): Xaa can be any naturally occurring amino acid
  unsure (1)..(952): unsure at all Xaa locations
MGGLEEIKNEAVDLENIPIEEVFEQLKCTREGLSSSEGQQRLEIFGPNRLEEKKESKILKFLGFMWNPLSWVMEMAAIMAIALANGGGKPPDWQDFVGIIVLLVINSTISFIEENNAGNAAAALMANLAPKTKVLRDGRWGEQEAAILVPGDIISIKLGDIVPADARLLEGDALKVDQSALTGESLPVTKGPGDEVFSGSTCKQGEIEAVVIATGVHTFFGKAAHLVDSTNQVGHFQQVLTAIGNFCICSIGVGILVEIIVMFPIQHRKYRSGIENLLVLLIGGIPIAMPTVLSVTMAIGSHKLSQQGAITKRMTAIEEMAGMDVLCSDKTGTLTLNKLSVDKNLVEVFCKGVDKDHVLLLAARASRTENQDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLPLFDPPRHDSAETIRKALVLGVNVKMITGDQLAIGKETGRRLGMGTNMYPSSALLGQNKDATLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFMLIALIWQYDFSPFMVLIIAILNDGTIMTISKDRVKPSPLPDSWKLKEIFATGIVLGSYLALMTVIFFWAMHKTDFFSDKFGVRSIRDSEHEMMSALYLQVSIVSQALIFVTRSRSWSFVERPGLLLVTAFLLAQLVATFLAVYANWGFARIKGIGWGWAGVVWLYSIVFYFPLDLLKFFIRFVLSGRAWDNLLENKTAFTTKKDYGREEREAQWATAQRTLHGLQPPEASSNTLFNDKSSYRELSEIAEQAKRRAEIARLRELNTLKGHVESVVKLKGLDIDTIQQNYTVX

SEQ ID NO: 11847 - protein, 173 aa, Zea mays
  misc_feature (173)..(173): Xaa can be any naturally occurring amino acid
  unsure (1)..(173): unsure at all Xaa locations
PRPPQTPRSAAAAMDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLAGVTIAHGGVLPNINPVLLPKKTAEKASSGGSKEAKSPRKAAKSPKKAX

SEQ ID NO: 11848 - protein, 340 aa, Zea mays
  misc_feature (340)..(340): Xaa can be any naturally occurring amino acid
  unsure (1)..(340): unsure at all Xaa locations
MVGTAAGSAEEAVRRWVDAAGGRLVLDGGLATELEANGANLNDPLWSAKCLLSSPHLIRKVHMDYLEAGANIIITASYQATIQGFESKGFSKEQSEKLLTKSVEIALEAREMFLKEHLEKSTPIQHPVLVAASLGSYGAYLADGSEYSGDYGEAGTKEFLKDFHRRRLQVLAEAGPDLIAFETIPNKLEAEAYVELLEECNINIPAWFSFNSKDGVHIVSGDSLIECATIADKCAKVGAVGINCTPPRFIHGLILSIRKVTDKPILIYPNSGERYDGEKKEWVESTGVSDGDFVSYVNEWCKDGAVLIGGCCRTTPNTIRAIHRTLNKSPNKQQLPAVEX

SEQ ID NO: 11849 - protein, 693 aa, Zea mays
  misc_feature (693)..(693): Xaa can be any naturally occurring amino acid
  unsure (1)..(693): unsure at all Xaa locations
MWRLKIGEGGGPWMQTVSGFHGRQVWEYDPDAGTDEERSKVEQLRREFTENRFRRRESQDLLMRMQLTGQKHLLADMRAATKIEDGDEVTEESLQESLKRALGWMSGLQAEDGHWPGDYSGIMYIMPFWIFALHITGSIDAVLSKEHRREICRHIYNHQVIGVYDWRGNNPVVPELWLVPRFLPIHPGRFWCFTRITYMSIAFLYGKKFIGPITPTILELREELYSLPYVQIDWSKARNSCAKEDIRNKPSEIFKFISTCLNMFVEPVLNYWPLNKLRERALNHILEHIHYEDETTQYIGISPVTKALNMICCWVENPNSDALKRHIPRIHDYLWIAEDGMNTKIYDGTHNWELALIIQAMLSADAANEYGPTIQRAMEYLKRAQVTTNPPGNPSYWFRHRSKGSWPLSTIDNGWGSSDTSAEATKALLMISKVYPNLVENSNGDEWMLNAVDCLLSFMNKDGSVSTFECQRTYSWLEILNPLESFRNIVADYPTVECTSSVLQALVLFEEFNSEYRSKEIKENVKKAAIYIENNQNKDGSWYGTWGICFVYGTLYAIKGLVAAGRNYENSICIRKACNFLLSIQLKTGGWAESYHSCERQVYVEGHSTHVVQTAWAMLALIYTGQMERDPTPLHRAAKVLINMQLETGDYAQQEHVGSTNCSVYFNYPNYRILFPVWALGEYHRKVCTKSNX

SEQ ID NO: 11850 - protein, 625 aa, Zea mays
  misc_feature (625)..(625): Xaa can be any naturally occurring amino acid
  unsure (1)..(625): unsure at all Xaa locations
KRRLALRPLPQAPTMGAGATARDEETATGRHHGRKPHGAAAEYAQDGSVDLRGNPVLRSQRGGWTACSFIVVYELFERMAYYGISSNLIIYLTDKLHQGTVEASNNVTNWSGTVFLTPLLGAYVADAYLGRYWTFVVGSAIYLLGMVLLVLSVSVPALKPPPCGAGGVCPQASALQLGAYFGGLYVVALGNGGTKPNISTIGADQFDEFDPRERTHKLSFFNWWMFTIFLGILFSSTVLVYLQDNVSWSVGYGIPTLGLMVSISVFLAGTRLYRHRVPQGSPFTSMGRVLAAALWKWSVPVPADAKELHELDVEEYARKRRFRMDSTDAMAFLNKAAAVPSGGSAAMPAWSLCTVTQVEETKQILRLVPLLAAMIVPCTLIAQTNTLFVKQGTTMDRHMGPRFEIPAASLGAFVTLTMLVAVVVYDRVFVRAVRRYTKDPRGITILRRMGTGMLLQVATMAVASAIESRRLAYARSHGLDATGGQLGLTIFALLPQFVLMGLADAFLVVGKIEFFYDQAPESMKSLGTAMSLTAYGIGNFLSSFLLSTVTRVTRDRGHAWVTNNLNASNLDYYYAFLTALGVVNFVAFLALSARYRYKAQSTDTIDAAVGLETEKAKLQAEPLGX

SEQ ID NO: 11851 - protein, 450 aa, Zea mays
  misc_feature (450)..(450): Xaa can be any naturally occurring amino acid
  unsure (1)..(450): unsure at all Xaa locations
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKKISEAQFSCPSWFSAGAKNMITRILDPNPTTRITISQILEHPWFKKGYKPPVFDEKYQTSLDDVDAAFGDSEDRHVKEETEDQPTSMNAFELISLNQALNLENLFEAKEEYKRETRFTSQCPPKEIITKIEEAAKPLGFDVQKKKYKMRMENPKAGRKGNLNVATEVFQIAPSLHVVELKKAKGDTLEFQKFYRSLSTQLKDVVWKCDGEVDGNSAAAX

SEQ ID NO: 11852 - protein, 361 aa, Zea mays
PPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSGNCYNQTSPISAASSYRGGTSQEMLRATEEVLATSRVPVGLVNITRLSEYRRDAHTQTYKKQWVEPTAEQRADPRSYADCTHWCLPGVPDTWNELLYWKLFFP

SEQ ID NO: 11853 - protein, 389 aa, Zea mays; identical to SEQ ID NO: 9912
  misc_feature (389)..(389): Xaa can be any naturally occurring amino acid
  unsure (1)..(389): unsure at all Xaa locations

SEQ ID NO: 11854 - protein, 504 aa, Zea mays; identical to SEQ ID NO: 10559
  misc_feature (504)..(504): Xaa can be any naturally occurring amino acid
  unsure (1)..(504): unsure at all Xaa locations

SEQ ID NO: 11855 - protein, 346 aa, Zea mays
  misc_feature (346)..(346): Xaa can be any naturally occurring amino acid
  unsure (1)..(346): unsure at all Xaa locations
AFTARPRLFFSCSPLPACAPFRGTTGRPPLYASCSDLVGPLRRRPSPVRAMMGGWGVSDGYEGSKRTRMMMESNPYFAVNAGSPLDVSKRSRIVEPGPPYFGAMGSNTGGASGGFYQPFNSSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESEYRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRHX

SEQ ID NO: 11856 - protein, 362 aa, Zea mays
PPLPFAVGAAPAGCDVAQGEWVRDDDARPWYQEWECPYIQPQLTCQAHGRPDKAYQSWRWQPRGCSLPSSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFP

SEQ ID NO: 11857 - protein, 198 aa, Zea mays
  misc_feature (198)..(198): Xaa can be any naturally occurring amino acid
  unsure (1)..(198): unsure at all Xaa locations
RMGKVWIEKLIAYHPRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11858 - protein, 187 aa, Zea mays
  misc_feature (187)..(187): Xaa can be any naturally occurring amino acid
  unsure (1)..(187): unsure at all Xaa locations
AYHLRLYISSLSAPPPPPDPSKTGIAMSDSEEHHFESKADAGASKTYPQQAGTVRKNGFIVIKNRPCKVVEVSTSKTGKHGHAKCHFVAIDIFNGKKLEDIVPSSHNCDIPHVNRTEYQLIDISEDGFVSLLTSDGNTKDDLRLPTDETLVAQIKEGFESGKDLVVTVQSAMGEEQICALKDVGPKX

SEQ ID NO: 11859 - protein, 640 aa, Zea mays; identical to SEQ ID NO: 10832
  misc_feature (640)..(640): Xaa can be any naturally occurring amino acid
  unsure (1)..(640): unsure at all Xaa locations

SEQ ID NO: 11860 - protein, 345 aa, Glycine max; identical to SEQ ID NO: 10297
  misc_feature (345)..(345): Xaa can be any naturally occurring amino acid
  unsure (1)..(345): unsure at all Xaa locations

SEQ ID NO: 11861 - protein, 332 aa, Glycine max
  misc_feature (332)..(332): Xaa can be any naturally occurring amino acid
  unsure (1)..(332): unsure at all Xaa locations
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGSX

SEQ ID NO: 11862 - protein, 708 aa, Glycine max
  misc_feature (708)..(708): Xaa can be any naturally occurring amino acid
  unsure (1)..(708): unsure at all Xaa locations
DLSALSSYRTLGKLLPLPSHSQWGLHFLAHAHPLHQMKKRPCGVYASLSESGEYYSHRPPTPLLDTVNYPIHMKNLSTKELKQLADELRSDVIFSFSRTGGHLGSSLGVVELTVALHYVFNAPQDKILWDVGHQSYPHKILTGRRDQMHTMRQTNGLSGFTKRSESEFDCFGTGHSSTTISAGLGMAVGRDLKGRKNNVVAVIGDGAMTAGQAYEAMNNAGYLDSDMIVILNDNKQVSLPTATLDGPIPPVGALSSALSRLQSNRPLRELREVAKGVTKRIGGPMHELAAKVDEYARGMISGSGSSLFEELGLYYIGPVDGHNIDDLVAILNEVKSTKTTGPVLIHVITEKGRGYPYAEKAADKYHGVTKFDPPTGKQFKSKATTQSYTTYFAEALIAEAEADKDVVAIHAAMGGGTGMNLFHRRFPTRCFDVGIAEQHAVTFAAGLACEGLKPFCAIYSSFMQRAYDQVVHDVDLQKLPVRFAMDRAGLVGADGPTHCGSFDVTFMACLPNMVVMAPSDEADLFHMVATAAAINDRPSCFRYPRGNGIGVQLPTGNKGTPLEIGKGRILIEGERVALLGYGSAVQNCLAAASLVECHGLRLTVADARFCKPLDRSLIRSLAKSHEVLITVEEGSIGGFGSHVAQFMALDGLLDGKLKWRPIVLPDRYIDHGSPADQLSLAGLTPSHIAATVFNVLGQTREALEVMSX

SEQ ID NO: 11863 - protein, 499 aa, Glycine max
  misc_feature (499)..(499): Xaa can be any naturally occurring amino acid
  unsure (1)..(499): unsure at all Xaa locations
INGFWRKEEILVLWVEVRREGMWSSTSSTAAIPSDEEPSESSSSSSFSTSLFNFSSGNPRIEETRGLMHLFPDDTPSTLPVGRKPLVCVVGVPNHMTYADFCQFCGSFIQHMLEMRIVRMDGMEDQYSVLVRFDDQDSTDSFYKHYNGRRFSSLEVEVCRVLFTLDVQYTGSIEHAQPSNATSTELPTCPVCLERLDQDTGGILTTICNHSFHCSCISKWADSSCPVCRYCQQQAEKSICFVCQTTENLWICVICGYVGCGRYKGGHAIIHWKETQHCYSLEVETKRVWDYVGDNYVHRLIQSKTDGKLIELNTQCAHADNGCGSCSCEDNAMNEAILNSKVEAIVNEYNELLATQLENQKLYFESLLQEVKEESERKISKAVQKAISLKQQKIQSKIDRCKKEKKFLDDLNENLVKNEDIWKTKILAIEEREKKTTRLMGDRVADLEMQLGDLMVCLEGGRTVEQLAASDEIKEGIILDKSIESSTTSGSDLVGRDAX

SEQ ID NO: 11864 - protein, 222 aa, Glycine max
  misc_feature (222)..(222): Xaa can be any naturally occurring amino acid
  unsure (1)..(222): unsure at all Xaa locations
AQALVGSYPLLLLLLEMTRKRIQIKKIDNISSRQVTFSKRRKGLFKKAQELSTLCDADIALIVFSATSKLFEYASSSMHQVIERRDSHSAMNRLDRPSIELQIENDSNEILRKKVEDKNRELRQMNGEDLQGLTLQELHKLEEHLKRGLINVSKVKDEKLMQEISTLKRKGVELMEENQRLKQVVPSLIHVHRQSSESILSNSSNLPEDGGSDTSLKLGLPX

SEQ ID NO: 11865 - protein, 365 aa, Oryza sativa
  misc_feature (365)..(365): Xaa can be any naturally occurring amino acid
  unsure (1)..(365): unsure at all Xaa locations
LLTRSLSLPRERERERERAVQVSLAMARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEAX

SEQ ID NO: 11866 - protein, 292 aa, Oryza sativa
  misc_feature (292)..(292): Xaa can be any naturally occurring amino acid
  unsure (1)..(292): unsure at all Xaa locations
LPPPHSSPPVPGAASKTPTPKSQPRSARSLSRLAMAPSDDLVYMAKLAEQAERYDEMVEAMNSVAKLDEGLTKEERNLLSVGYKNLIGAKRAAMRIIGSIELKEETKGKESHVRQTAEYRRKVEAEMDKICCDVINIIDKYLIPHSSGAESSVFYYKMKGDYYRYLAEFKTGTEKIEVSELSLNAYETASKTAQTDLTPTDPIRLGLALNISVFYCEIMNSPDKACQLAKNAFDEAVAELPSLSEENYKDSTLIMQLLRDNLALWNSDMADDADDIRERTDTTGAKGDPAAX

SEQ ID NO: 11867 - protein, 349 aa, Oryza sativa
  misc_feature (349)..(349): Xaa can be any naturally occurring amino acid
  unsure (1)..(349): unsure at all Xaa locations
ERAVQVSLAMARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEAX

SEQ ID NO: 11868 - protein, 274 aa, Oryza sativa
  misc_feature (274)..(274): Xaa can be any naturally occurring amino acid
  unsure (1)..(274): unsure at all Xaa locations
MSPAADSAASKRQAELLKQEGNAFFKKDRISAAIDAYTGAIALCPKVAVYWTNRALCYKRRNEWVRAEEDCRTAIQLDSHSVKAHYMLGLALLNKDELAEGIKELEKSLELGRGAHPASYMVEEIWQELSKAKYIEWENLSSERVRQLHKLKEACKEALRNYNSLDNPPAYVPEEQLNELEEVFRNARKSDIPTEVPDHLCCKITLDIFRDPVITPSGITYERAVILDHLHRVGKFDPVTRETLEPHQLVPNLAIKEAVHAFLSEHGWAYRMRX

SEQ ID NO: 11869 - protein, 331 aa, Oryza sativa
  misc_feature (331)..(331): Xaa can be any naturally occurring amino acid
  unsure (1)..(331): unsure at all Xaa locations
FSHLLPSPRSSPSAAAAAEQQQQASDMGGFVKTQKTHAYFKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDEX

SEQ ID NO: 11870 - protein, 236 aa, Oryza sativa; identical to SEQ ID NO: 11058
  misc_feature (236)..(236): Xaa can be any naturally occurring amino acid
  unsure (1)..(236): unsure at all Xaa locations

SEQ ID NO: 11871 - protein, 274 aa, Oryza sativa; identical to SEQ ID NO: 11868
  misc_feature (274)..(274): Xaa can be any naturally occurring amino acid
  unsure (1)..(274): unsure at all Xaa locations

SEQ ID NO: 11872 - protein, 257 aa, Oryza sativa
  misc_feature (257)..(257): Xaa can be any naturally occurring amino acid
  unsure (1)..(257): unsure at all Xaa locations
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQX

SEQ ID NO: 11873 - protein, 257 aa, Oryza sativa; identical to SEQ ID NO: 11872
  misc_feature (257)..(257): Xaa can be any naturally occurring amino acid
  unsure (1)..(257): unsure at all Xaa locations

SEQ ID NO: 11874 - protein, 257 aa, Oryza sativa; identical to SEQ ID NO: 11872
  misc_feature (257)..(257): Xaa can be any naturally occurring amino acid
  unsure (1)..(257): unsure at all Xaa locations

SEQ ID NO: 11875 - protein, 257 aa, Oryza sativa; identical to SEQ ID NO: 11872
  misc_feature (257)..(257): Xaa can be any naturally occurring amino acid
  unsure (1)..(257): unsure at all Xaa locations

SEQ ID NO: 11876 - protein, 543 aa, Zea mays
  misc_feature (543)..(543): Xaa can be any naturally occurring amino acid
  unsure (1)..(543): unsure at all Xaa locations
ERFFFPPPTPQPTNTLYKAALSHTQNAQAQAGQENSAGQSASWMAFFLALVCILILLAIASYVQYTRWQKGKGRFGGHGRSAPLKLPPGSMGWPYLGETLQLYSQDPSFFFASKQKRYGEIFKTHLLGCPCVMLASPEAARFVLVTQAHLFKPTYPRSKERMIGPSALFFHQGDYHLRLRKLVQGALGPDALRALVPEVEAAVRSTLASWDAGHVRSTFHAMKTLSFDVGIVTIFGGRLDERRKAELRKNYSVVEKGYNSFPNSLPGTLHYKAMQARRRLHGVLCDIMRERRGQAQAAGTGLLGCLMRSRGDDGAPLLSDEQIADNVIGVLFAAQDTTASALTWIVKYLHDHPKLLEAVRAEQAAVREATGGGRQPLAWAHTKSMALTHRVILESLRMASIISFTFREAVADVEYKGFLIPKGWKVMPLFRNIHHSPDYFQDPHKFDPSRFQVAPRPSTFLPFGHGVHACPGNELAKLEMLVLIHHLVTGYRWQIVGSSDEVEYSPFPVPKHGLPVRLWRQNNPVDRKGRETDDDHVERIFIX

SEQ ID NO: 11877 - protein, 394 aa, Zea mays
  misc_feature (394)..(394): Xaa can be any naturally occurring amino acid
  unsure (1)..(394): unsure at all Xaa locations
MKVLVLAVLALVAAASAAGQGEEGGGPPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQVLX

SEQ ID NO: 11878 - protein, 283 aa, Zea mays
  misc_feature (283)..(283): Xaa can be any naturally occurring amino acid
  unsure (1)..(283): unsure at all Xaa locations
SILQSTHSIPLPTRRIHANAHAPTRHIQMMLRVSPSPAAAVPTQLSGAPATPAPVVRVAAPRGVASPAAGAACRAAGKGKEVLSGVVFQPFEEIKGELALVPQSPDKSLARHKFVDDCEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPQLTDFIESEFLEEQVEAINKISKYVAQLRRVGKGHGVWHFDQMLLEEEAX

SEQ ID NO: 11879 - protein, 431 aa, Zea mays; identical to SEQ ID NO: 11244
  misc_feature (431)..(431): Xaa can be any naturally occurring amino acid
  unsure (1)..(431): unsure at all Xaa locations

SEQ ID NO: 11880 - protein, 511 aa, Zea mays; identical to SEQ ID NO: 10153
  misc_feature (511)..(511): Xaa can be any naturally occurring amino acid
  unsure (1)..(511): unsure at all Xaa locations

SEQ ID NO: 11881 - protein, 288 aa, Zea mays
  misc_feature (288)..(288): Xaa can be any naturally occurring amino acid
  unsure (1)..(288): unsure at all Xaa locations
AGTAASLLAYFPYTRAQPQAVDRRMAPGGSGERWSLAGATALVTGGSKGIGQAVVEELARLGARVHTCARSAADLEECRRRWAEKGLRVTVSVCDVAVRADRERLVLDTVSAAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGAX

SEQ ID NO: 11882 - protein, 650 aa, Zea mays
  misc_feature (650)..(650): Xaa can be any naturally occurring amino acid
  unsure (1)..(650): unsure at all Xaa locations
MARFEVNGKSVQGVDLLRRRHWPSRLDFWPFLALYALWLLLAVPALDFTDALIILAALSAAHILTFLFTAWFVDFRAFVGYSKVKDIHAANTCKVTPAKFSGSKEIVPLHKQKNVASTSAAGETEEIYFDFRKQRFIYSAEKDNFLKLRYPTKELIGHYGKGTGYGTEAKISTAVDKWGRNVFEYPQPTFQKLMKEQIMEPFFVFQVFCVALWCLDAYWYYSLFTLFMLFLFESTMAKNRLKTLTELRRVKVDSQIVLTYRCGKWVKVPGTELLPGDIVSIGRSTSGEDRSVPADMLLLAGSAIVNEAILTGESTPQWKVSIAGRGPDDMLSIRRDKNHILFGGTKVLQHTADKSVNLRSPDGGCLAFVLRTGFETSQGKLMRTILFSTERVTANNKESGLFILFLLFFAIIASGYVLVKGLEDPTRSRYKLLLSCSLIITSVIPPELPMELSIAVNTSLIALARHGIFCTEPFRIPFAGKVDICCFDKTGTLTSDDMEFQGIVTSEGDDLISDANKLPLRTQEVLSSCHALVFVDNKLVGDPLEKAAIKGIDWIYTSDEKAMSKKPGGQPVQIVHRYHFASHLKRMSVIVRIQQKFYAFIKGAPETIQEKLVDLPAAYVETYKKYTRQGSRVLALAYKLLPEMPVSFCX

SEQ ID NO: 11883 - protein, 349 aa, Zea mays
  misc_feature (349)..(349): Xaa can be any naturally occurring amino acid
  unsure (1)..(349): unsure at all Xaa locations
MENGGAKGDVPDDANEHCPGTQSEEAGKADACAGCPNQQICATAPKGPDPDVVAIVERLATVKHKLLVLSGKGGVGKSTFSAQLSFALAEMDHQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPVLGVVENMSGLRQPLSDLRFIKSDEAGKTDATEWALNYIKEKAPELLSVMACSEVFDSSKGGAEKMCHEMGVPFLGKVPMDPQLCKAAEEGRSCFADQKCSASAPALRNIVKKLIKAEX

SEQ ID NO: 11884 - protein, 691 aa, Zea mays
  misc_feature (691)..(691): Xaa can be any naturally occurring amino acid
  unsure (1)..(691): unsure at all Xaa locations
ASRRQGVCIGLSEVMGSAGKHQLLSFMDELIPTIRTALCDSTQEVRESAGLAFSTLYKSAGLQAIDEIVPTLLRALEDDDTSATALDGLKQILSVRTAAVLPHILPKLVQPPLSSFNAHALGALAEVAGPGLNSHIGTVLPALILAMDDEDADVQNSARKAAETVLLVIDEEGVETLIPELLRGINDSQASMRRGSAYLIGFLFKNTKLYLADEASDMMSTLIILLSDTDKATVSAALEAFSRVVASVPKEQLPTHIKLVRDAVSTARDKERRRRKGVPILVPGLCLPKALQPFLPIYQQGLISGSAETKEQAAEGLGELIDVTSEKTLKEVVVPITGPLIRILGDRFPWQVKSAILSTLTIIIMKGGIALKPFLPQLQTTFVKCLQDNNRSVRARAAAALGKLSALSTRVDPLVSDLLSMLQSGDESVKESVLSALKGVIKHAGKSVSSAIRSRGCALLEDLLQAEADDVRSCAAKVIGTLSQYMEETEISDLVQILLNMSTSSDWCTRHGALLSFSYISMHSPSKLCHLASFPSLVDLLKGSLKDDKFPVREVATRTLGKILCFELQPEAGTLQLVQLLILALRDDSSEVRRRSLSCIKAAAKTNHSALATHHSILGPAIAEALKDSSMPVRLAAERCALHVFQLTKGPDNVTAAQKYLGMTGLEVKKIAKLDVDSDGSESSDDDKRTX

SEQ ID NO: 11885 - protein, 246 aa, Zea mays; identical to SEQ ID NO: 11544
  misc_feature (246)..(246): Xaa can be any naturally occurring amino acid
  unsure (1)..(246): unsure at all Xaa locations

SEQ ID NO: 11886 - protein, 534 aa, Zea mays
  misc_feature (534)..(534): Xaa can be any naturally occurring amino acid
  unsure (1)..(534): unsure at all Xaa locations
AVIYLLAVSKGSESTTTTAQQLPRTEKKKRTAPNLGKIDMAENNVVATYYYPTAAPAAMEVCGAELGQGKPDKCFDDDGRPKRNGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSYX

SEQ ID NO: 11887 - protein, 390 aa, Zea mays
  misc_feature (390)..(390): Xaa can be any naturally occurring amino acid
  unsure (1)..(390): unsure at all Xaa locations
DYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 11888 - protein, 370 aa, Zea mays
GPREVFMCGVAQYVNLWGTMVGYTITATISMAAIRQADCLRRDGAGAGARCDAPGTVLMLAFSVVQVVLSQFPGLEHITWLSVVAAAMSFAYSFAGLGLSVGHWVSRGGGGLGGRVAGAAAASSTRKLWNVLLALGNIAFAYTFAEVLIEIQDTLKSPPPENRTMKKAAMYGIGATTIFYISVGCAGYAAFGSNAPGNILAAGGLGPLWLVDIANMCLILHLIGAYQVYAQPVFASVERWAASRWPEAKFMSSAYTVSVSIPLLQRGSVTVAPHKLVLRTAIVGATTAVALAIPFFNAVLGLLGAFSFWPLTVYFPISMHIAQGKIARGTKWWCLLQALSMVCLVISVAVGVGSVTDIVDSLKASSSPFK

SEQ ID NO: 11889 - protein, 540 aa, Zea mays; identical to SEQ ID NO: 10189
  misc_feature (540)..(540): Xaa can be any naturally occurring amino acid
  unsure (1)..(540): unsure at all Xaa locations

SEQ ID NO: 11890 - protein, 401 aa, Zea mays; identical to SEQ ID NO: 10260
  misc_feature (401)..(401): Xaa can be any naturally occurring amino acid
  unsure (1)..(401): unsure at all Xaa locations

SEQ ID NO: 11891 - protein, 406 aa, Zea mays
  misc_feature (406)..(406): Xaa can be any naturally occurring amino acid
  unsure (1)..(406): unsure at all Xaa locations
DSPAPMAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDEX

SEQ ID NO: 11892 - protein, 474 aa, Zea mays; identical to SEQ ID NO: 11597
  misc_feature (474)..(474): Xaa can be any naturally occurring amino acid
  unsure (1)..(474): unsure at all Xaa locations

SEQ ID NO: 11893 - protein, 420 aa, Zea mays
  misc_feature (420)..(420): Xaa can be any naturally occurring amino acid
  unsure (1)..(420): unsure at all Xaa locations
MELLPVEVVGNILSHLGVARDVMIASAVCRKWRDACRRHLRLLSFNSNDFPRDMTTRQLEIVITQTIFQTMGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYEX

SEQ ID NO: 11894 - protein, 557 aa, Zea mays
  misc_feature (557)..(557): Xaa can be any naturally occurring amino acid
  unsure (1)..(557): unsure at all Xaa locations
MGNACGGALRSKYQHSFKHAASSQRRASSEYSASAVADDSPRKPTQPPATTDAHAPPPPPATAAAAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAKRLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAFX

SEQ ID NO: 11895 - protein, 830 aa, Zea mays
  misc_feature (830)..(830): Xaa can be any naturally occurring amino acid
  unsure (1)..(830): unsure at all Xaa locations
TNSSLVWAVAVRRRVKRDETTMRKWALSSALLLLFLLTTLPDPAKKLQVNAEESSDDLANPPKVEEKLGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGIGMTKEDLINNLGTIAKSGTSAFVEKMQSGGDLNLIGQFGVGFYSVYLVADYVEVVSKHNDDKQYVWESKADGSFAISEDTWNEPLGRGTEIRLHLRDEAKEYLEEDKLKDLVKKYSEFINFPIYLWSTKEVDVEVPADEDETSEEEDSSPETTEEETEEDEEKEKKPKTKTIKETTSEWELLNDMKAVWLRSPKEVTDEEYSKFYHSLAKDFGDDKPMGWSHFTAEGDVEFKALLFIPPKAPHDLYESYYNSNKSNLKLYVRRVFISDEFDDLLPKYLSFLRGIVDSDTLPLNVSREMLQQHSSLKTIKKKLIRKALDMIRKLAEEDPDEYSNKDKTDEEKNEMEEKKGQYAKFWNEFGKSIKLGIIEDATNRNRLAKLLRFESTKSDGKLASLDEYISRMKPGQKDIFYLTGSSKDQLEKSPFLERLTKKNYEVIFFTDPMDEYLMQYLMDYEDRKFQNVSKEGLKLGKDSRLKDLKESFKELTEWWKKALESESVDSVKVSSRLHDTPCVVVTSKYGWSANMEKIMQAQTLSDSSKQAYMRGKRVLEINPRHPIIKELRDKVAQDNESEELKQTARLVYQTALMESGFNLPDPKEFASSIYKSVHKSLDLSPDAAVEEEDEAEEQPEVEEKEPAAKEGSEPSFDKDELX

SEQ ID NO: 11896 - protein, 380 aa, Zea mays; identical to SEQ ID NO: 10029
  misc_feature (380)..(380): Xaa can be any naturally occurring amino acid
  unsure (1)..(380): unsure at all Xaa locations

SEQ ID NO: 11897 - protein, 415 aa, Zea mays
  misc_feature (415)..(415): Xaa can be any naturally occurring amino acid
  unsure (1)..(415): unsure at all Xaa locations
KCKECEEAVAKGFHSRVLGVVHRSSSVKEREREQAMATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMEDX

SEQ ID NO: 11898 - protein, 295 aa, Zea mays; identical to SEQ ID NO: 10169
  misc_feature (295)..(295): Xaa can be any naturally occurring amino acid
  unsure (1)..(295): unsure at all Xaa locations

SEQ ID NO: 11899 - protein, 401 aa, Zea mays; identical to SEQ ID NO: 10260
  misc_feature (401)..(401): Xaa can be any naturally occurring amino acid
  unsure (1)..(401): unsure at all Xaa locations

SEQ ID NO: 11900 - protein, 907 aa, Zea mays
  misc_feature (907)..(907): Xaa can be any naturally occurring amino acid
  unsure (1)..(907): unsure at all Xaa locations
MPSSSPCYRHSFLFLALLSACFSTPGAADGTGGAGDGGDAAAMQALRRDLAPPGWGPGADHCAWRGVTCAAAGAGGVVTAIELPRRGLRGDFAAAAALRALARLDLSANSLSGGLSPAFGALTRLEYLDLSMNALTGAVPAALAGASALRFLNLSNNALSGAIPDDLRGLKKLQELQISGNNLTGSLPGWLARLPGLRVLSAYENALSGPIPPGLGLSSELQVLNLHSNALEGSIPSSLFELGNLQVLILTMNRLNGTIPDTIGRCRGLSNVRIGDNLLSGAIPASIGDATGLTYFEANTNDLSGGIPTQFARCANLTLLNLAYNRLAGEVPDVLGELRSLQELIVSGNGLCGEFPKSILRCRNLSKLDLSYNAFRGGLPESICNGSRMQFLLLDHNEFSGGIPAGIGGCTRLLELHLGSNNLSGEIPAEIGKVKSLQIVLNLSFNHFTGPLPHELGRLDKLVMLDLSSNEMSGQIPSDMRGMLSLIEVNLSNNRFSGAIPVFGPFQKSAASSFSGNAKLCGNPLNVDCGSIYGSNYRMDHRGISYRVALAVVGSCVLIFSLVSLVVALFMWREKQEKEEDAKKKAEAGEVVVAAPQVVASSVFIDSMQQAIDFQSCMKATLKDANEVSNGTFSTSYKAVMPSGMVVCVKKLKSVDRAVIHQQTKMIRELERLAHINHKNLVRPVGYVIYDDVALLLHQHMLNGTLLQLLHSSGGDTDGKKQKPDWPRLLSIAIDVAEGLAFLHQVATIHLDICSGNVFLDSHYNALLGEVEISKLLDPSKGTASISTVAGSFGYIPPEYAYTMQVTVPGNVYSYGVVLLEILTSKLPVDDVFGEGVDLVKWVHTAPARGETPEQIMDPRLSTVSFAWRRQMLAVLKVAMLCTERAPAKRPRMRKVVEMLQEAKNSX

SEQ ID NO: 11901 - protein, 344 aa, Zea mays
  misc_feature (344)..(344): Xaa can be any naturally occurring amino acid
  unsure (1)..(344): unsure at all Xaa locations
RATHWCYACQRPIRLRGQDIICPNCSDGFIQEISEMGGVLNTYGLTEPDFEERQARRFGMMDAISSLMRQRLSEIGRDSLFDIHGRQGTGTEYGRRSTAIPTLVFGGIPSPAVGSSDINVVIREGRRAGAARPNFSSLVVGPSLEALFEQLLLQNNRQGPPPAPQSAIDSMPVVKINRRHLDEDPQCAVCKDKFEVGAEAREMPCKHLYHTDCIIPWLVQHNSCPVCRHPLPSQRSGSSTSSARVPSAYYNETACPPAVARADFDPVPSAYYNETATDPPAVTRADFDPAPGNYGSESQESHVPFSFLWPFGPSSSYQYEENVDEPAVYDPNQIAYSAWHYDHX

SEQ ID NO: 11902 - protein, 420 aa, Zea mays
  misc_feature (420)..(420): Xaa can be any naturally occurring amino acid
  unsure (1)..(420): unsure at all Xaa locations
AARPGRIASPGRPGTRGRRATLAIKDLPPPATGPCASKLKRKADPRVDCGGPAMVMMMRSCLGGGLLPVAVMLCLNVVAAVMVSLVKVAMDGGMKPLVIVTLQQLTAAVFLAPIAFFKERKSRPKLTLEIFAYIFVSAALGAALRQYMIFVALRYTTATFVTAFSNIAPVLTFLLAVATRSEALDLKSRTGLAKLLGTLVSLAGAMVLTLYKGVALTHAAAASQDQQQHSHGRLPPSAADSRGKWTLGTVAILGNCVCLSCWFLLHGRLAKKYPHVYSCNALMSLLSFLQVAVVGLCTQRSISPWIVTSKFNILTVLYAGIVGCGVSFVLVTWCIEKRGAVFVAAFIPVVQIIVSVIDFSILHEQLYLGSVLGSVLVIGGLYLLLWGKRQEALHCPPPPPPKVAEEDPADKEQQQVQHNX

SEQ ID NO: 11903 - protein, 511 aa, Zea mays
  misc_feature (511)..(511): Xaa can be any naturally occurring amino acid
  unsure (1)..(511): unsure at all Xaa locations
MAQLAVRSLLLSLLLVSPVVASPGIVKLNSSSTLFGIEFPPFNTAVAATGCDSKLVAADEAGDEQKQPASSSPSLQLRMKHRSAEGGRTRKESFLDKAEKDAVRIETMHRRAARSGVARMPASSSPRRALSERMVATVESGVAVGSGEYLIDVYVGTPPRRFRMIMDTGSDLNWLQCAPCLDCFEQRGPVFDPAASSSYRNVTCGDQRCGLVAPPEAPRACRRPAEDSCPYYYWYGDQSNTTGDLALESFTVNLTAPGASRRVDGVVFGCGHRNRGLFHGAAGLLGLGRGPLSFASQLRAVYGHTFSYCLVEHGSDAGSKVVFGEDYLVLAHPQLKYTAFAPTSSPADTFYYVKLKGVLVGGDLLNISSDTWDVGKDGSGGTIIDSGTTLSYFVEPAYQVIRQAFVDLMSRLYPLIPDFPVLNPCYNVSGVERPEVPELSLLFADGAVWDFPAENYFVRLDPDGIMCLAVRGTPRTGMSIIGNFQQQNFHVVYDLQNNRLGFAPRRCAEVX

SEQ ID NO: 11904 - protein, 401 aa, Zea mays; identical to SEQ ID NO: 10260
  misc_feature (401)..(401): Xaa can be any naturally occurring amino acid
  unsure (1)..(401): unsure at all Xaa locations

SEQ ID NO: 11905 - protein, 984 aa, Zea mays
  misc_feature (984)..(984): Xaa can be any naturally occurring amino acid
  unsure (1)..(984): unsure at all Xaa locations
MMESAAAQSCAACGDDARAACRACSYALCRACLDEDAAEGRTTCARCGGDYAAINPARASEGTEAEEEVVENHHTAGGLRERVTMGSHLNDRQDEVSHARTMSSLSGIGSELNDESGKPIWKNRVESWKEKKNEKKASAKKTAAKAQPPPVEEQIMDEKDLTDAYEPLSRVIPISKNKLTPYRAVIIMRLIVLGLFFHYRITNPVNSAFGLWMTSVICEIWFGFSWILDQFPKWYPINRETYVDRLIARYGDGEESGLAPVDFFVSTVDPLKEPPLITANTVLSILAVDYPVEKISCYVSDDGSAMLTFESLAETAEYARKWVPFCKKYAIEPRAPEFYFSQKIDYLKDKIHPSFVKERRAMKRDYEEYKVRINALVAKAQKTPDEGWIMQDGTPWPGNNPRDHPGMIQVFLGETGARDFDGNELPRLVYVSREKRPGYQHHKKAGAMNALVRVSAVLTNAPYILNLDCDHYVNNSKAVREAMCFMMDPTVGRDVCYVQFPQRFDGIDRSDRYANRNVVFFDVNMKGLDGLQGPVYVGTGCCFNRQALYGYGPPSLPALPKSSICSWCCCCCPKKKVERSEREINRDSRREDLESAIFNLREIDNYDEYERSMLISQMSFEKSFGLSSVFIESTLMENGGVPESANPSTLIKEAIHVISCGYEEKTEWGKEIGWIYGSVTEDILTGFKMHCRGWRSIYCMPVRPAFKGSAPINLSDRLHQVLRWALGSVEIFFSRHCPLWYGYGGGRLKWLQRLSYINTIVYPFTSLPLVAYCCLPAICLLTGKFIIPTLSNAATIWFLGLFMSIIVTSVLELRWSGIGIEDWWRNEQFWVIGGVSAHLFAVFQGILKMIAGLDTNFTVTAKATDDTEFGELYLFKWTTVLIPPTSILVLNLVGVVAGFSAALNSGYESWGPLFGKVFFAMWVIMHLYPFLKGLMGRQNRTPTIVVLWSVLLASVFSLLWVKIDPFVGGTETVNTNNCNTIICX

SEQ ID NO: 11906 - protein, 328 aa, Zea mays
  misc_feature (328)..(328): Xaa can be any naturally occurring amino acid
  unsure (1)..(328): unsure at all Xaa locations
RPSTTPASQSSPPPTTTTPPLAAARSRPIRPDRPAMDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHAX

SEQ ID NO: 11907 - protein, 166 aa, Zea mays; identical to SEQ ID NO: 10649

SEQ ID NO: 11908 - protein, 272 aa, Zea mays; identical to SEQ ID NO: 11306
  misc_feature (272)..(272): Xaa can be any naturally occurring amino acid
  unsure (1)..(272): unsure at all Xaa locations

SEQ ID NO: 11909 - protein, 459 aa, Zea mays
  misc_feature (459)..(459): Xaa can be any naturally occurring amino acid
  unsure (1)..(459): unsure at all Xaa locations
SFRGLVFSEDSAMAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPPFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFNEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 11910 - protein, 473 aa, Zea mays
  misc_feature (473)..(473): Xaa can be any naturally occurring amino acid
  unsure (1)..(473): unsure at all Xaa locations
MSSARVRGPFTPPQWIELEHQALIYKYLSANSPVPHSLLVPIRRSGSLASSPYPPPYFGTSTFGWGSFQLGYSGNADLEPGRCRRTDGKKWRCSRDAVADQKYCERHMNRGRHRSRKHVEDQPGHAAKAMSAVAVAAAAAAATQHAAALAGAGATAAAGLAVNRHRQPGKSYATGATDPCSLQYSRELANKLSNESENMQDSDNVSMLTSMNTGNTAGSVFPFSKQNTALFEVSSSRPEFGLVPSDSLTSSPHSSLKSVKNLLSSRSLSEHQSSASLQHFVDWPRTPPAQGGLSWPEAEDMPRAQRSQLSVSAPMASSELSSASTSPIHDHEKLILSPLKLGREYTPSGVVSAAANRYEVSQLEATWATMFRDSSTGGPLGEVLAKNNSNAEARGCPSAAPPLTDYYCWDSGHGMQSSPVGVLQRTTAFGSVSSSTGSSPRVENHGACCDGTSNLMDDLGSVVVRHPSIRLLX

SEQ ID NO: 11911 - protein, 206 aa, Zea mays
  misc_feature (206)..(206): Xaa can be any naturally occurring amino acid
  unsure (1)..(206): unsure at all Xaa locations
MGSLLCCMGCSEDVSAAPPVSCLCLLWPFHYYHNLNSGSAACHRCDTRVAPDGGRSPPANQVDSLDTLGLPPRPLPYDDPQSSPRMVQHPLVSGHDKAPTHVQKLGQPAETKNTHTGSTCTAHKVSASSPKQHSEGSRMDDGVQFCDSSDSEDDCPVCLEEYDYENPKIALQCKHNFHLSCIYEWMERSQACPVCAKTMLFNEDEX

SEQ ID NO: 11912 - protein, 664 aa, Zea mays
  misc_feature (664)..(664): Xaa can be any naturally occurring amino acid
  unsure (1)..(664): unsure at all Xaa locations
MSREAQKLDCATGGGGGVGIGVLSLDLLGQVLDRLREPRDRKACRLVSRAFERSEAAHRRALRVLRREPLPRLLRAFPALERLDLSACASLDDASLAAAVAGAGGGLAGLRSVCLARANGVGWRGLEALVAACPKLEAVDLSHCVSAGDREAAALAAAAGLRELRLDKCLAVTDMGLAKVAVGCPRLEKLSLKWCREISDIGIDLLAKKCPELRSLNISYLKVGNGSLRSISSLERLEELAMVCCSCIDDEGLELLSKGSDSLQSVDVSRCDHVTSHGLASLIDGRNFLQKLYAADCLHEIGQRFVSKLATLKETLTTLKLDGLEVSDSLLEAIGESCNKLVEIGLSKCSGVTDEGISSLVARCSDLRTIDLTCCNLSTNNALDSIAGNCKMLECLRLESCSLINEKGLKRIATCCPNLKEIDLTDCGVDDAALEHLAKCSELRVLKLGLCSSISDKGIAFISSNCGKLVELDLYRCSSITDDGLAALANGCKRIKLLNLCYCNKITDTGLGHLGSLEELTNLELRCLVRITGIGISSVAIGCKNLIELDLKRCYSVDDAGLWALARYALNLRQLTISYCQVTGLGLCHLLSSLRCLQDIKMVHLSWVSIEGFEIALRAACGRLKKLKMLCGLKTVLSPELIQMLQACGCRIRWVNKPLVYKDX

SEQ ID NO: 11913 - protein, 262 aa, Zea mays; identical to SEQ ID NO: 9917
  misc_feature (262)..(262): Xaa can be any naturally occurring amino acid
  unsure (1)..(262): unsure at all Xaa locations

SEQ ID NO: 11914 - protein, 133 aa, Zea mays
MGISSMPAPEDSLLGFVLYNTAASVAILAGLVRAALLFLGLAAAAEDEEPRQQAEAVTVTAVGPSLADRFRSRFRPSRYGRRRGGDCRVCLVRFETESVVQRLPCGHLFHRACLETWIDYDHATCPLCRHRLL

SEQ ID NO: 11915 - protein, 393 aa, Zea mays
  misc_feature (393)..(393): Xaa can be any naturally occurring amino acid
  unsure (1)..(393): unsure at all Xaa locations
LPASLTSIGSSVFTMAAAHLLAALSSSTALRPPLRLRSPQHPPHIRFNCTGRRPFPVVRAAETDAKNAKANAKAPNKAPAADGSSFNQLLGIKGAKQESDIWKIRLQLTKPVTWPPLVWGVLCGAAASGNFHWTVEDVAKSIVCMIMSGPCLTGYTQTLNDWYDRDIDAINEPYRPIPSGAISENEVITQIWVLLLGGLGLGALLDVWAGHDFPIVFYLAVGGSLLSYIYSAPPLKLKQNGWIGNFALGASYISLPWWAGQALFGTLTPDIIVLTTLYSIAGLGIAIVNDFKSIEGDRTLGLQSLPVAFGMETAKWICVGAIDITQLSVAGYLLSTGKLYYALVLLGLTIPQVFFQFQYFLKDPVKYDVKYQASAQPFFVLGLLVTALATSHX

SEQ ID NO: 11916 - protein, 392 aa, Zea mays
  misc_feature (392)..(392): Xaa can be any naturally occurring amino acid
  unsure (1)..(392): unsure at all Xaa locations
MAAFAALFDPLYCPEEHLDLYRDEPGEGADEQWPGQHGQQEPAVLDDELPALFEAHRAKEGVVLAEDGGYGGAAGREAAVGWVSRAAARLGFSALTAALAAAYLDRCFLPGGALRLGDQPWMARLAAVTCFALAAKVEETRVPPLLDLQLYAAADAADPYVFEAKTVRRMELLVLSALGWRMHPVTPFSYLQPVLADAATRLRSCEGVLLAVMADWRWPRHRPSAWAAAALLITAAAGDGGDGDGDTELLALINAPEDKTAECAKIISEVTGMSFLACDVGVSAGNKRKHAAAQLYSPPPSPSGVIGALSCFSCESSTSATAMAAAVGPWAPSASVSVSSSPEPPGRAPKRAAAASASASASAGVAPPVQVPHQLPPDEESRDAWPSTCAAX

SEQ ID NO: 11917 - protein, 615 aa, Zea mays
  misc_feature (615)..(615): Xaa can be any naturally occurring amino acid
  unsure (1)..(615): unsure at all Xaa locations
DPLVLDRSMDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQX

SEQ ID NO: 11918 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11919 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11920 - protein, 582 aa, Zea mays
  misc_feature (582)..(582): Xaa can be any naturally occurring amino acid
  unsure (1)..(582): unsure at all Xaa locations
MADEAKAKGNAAFSAGRFEEAARHFTDAIALAPDNHVLYSNRSAALASLHRYSDALADAQKTVDLKPDWAKGYSRLGAAHLGLGDAASAVAAYEKGLELDPSNEGLKAGLQDAKKAAAAPPRRGSSGPDAIGQMFQGPELWSKIASDPSTRAYLNEPDFMHMMREVQRNPSSISMYLSDPRMMQVLSLMLNVKIQRPEASEPSQSTPPPPKQQQQQQTPPSETKARDVEPEPEAEPMDLTDEEKDRKQTKAAAQKEKELGNAAYKKKDFEVAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAEKAKKELEQQEYYDPKLADEEREKGNEFFKEQKYPEAIKHYTEALKRNPKDPRVYSNRAACYTKLGAMPEGLKDAEKCLELDPTFTKGYTRKGAIQFFMKEYDKAVETYQAGLKHDPNNQELLDGAKRCVEQINKANRGEISQDELQERQNKAMQDPEIQNILTDPIMRQVLIDFQENPSAAQEHLKNPGVMQKIQKLVSAGIVQMRX

SEQ ID NO: 11921 - protein, 636 aa, Zea mays
  misc_feature (636)..(636): Xaa can be any naturally occurring amino acid
  unsure (1)..(636): unsure at all Xaa locations
QSSAGALHLHSAALLPLPLSRSSSFSFSSSAASARAAMSEEDEDQPPAKRPSPSPPADQVLDNVLETVLQFLDAPRDRSAASLVCRSWHSAESATRESVAVRNLLAVSATRTARRFPNARSLLLKGRPRFADFNLLPHGWDASAFRPWAAAVAAGAFPALTSLYLKRIPVTDADLDLLSRSLPASFRDLTLHLCDGFTSRGLASIASHCRGLRVLDVVECDMAEEQEVVDWVAAFPQEPSNLESLSFECYEPPVAFAALEALVERSPRLRRLGVNLHVSLGQLCRLMAHAPRLSHLGTGSFRPADGGEEGTGFGEVVSAFVAAGRARTLVSLSGFRDLAQEYLPTIAVVCAHLKSLDLSYSAVTPNQILMFIGQCYNLETLWVLDSVRDEGLDAVGISCKKLQSLRVLPLNAHEDADELVSEVGLTAISRGCPALRSILYFCQTMTNAAVVDMSRNCPELKVFRLCIMGRHQPDHATGEPMDEGFGAIVQNCSKLTRLSTSGQLTDRAFEYIGRHGKSLRTLSVAFAGNSDVALQYILQGCPKLEKLEIRDCPFGDAGLFAGMHHFYNMRFVWMSGCNLTLQGCKEVAQVLPRMVVELINGQSDENERNESVDILYMYRSLDGPREDVPPFVKILX

SEQ ID NO: 11922 - protein, 191 aa, Zea mays
MSVETERSSTESSGASGLDFEDTALTLTLRLPGSAPSAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVNGTEYVPTYEDKDGDWMLVGDVPWK

SEQ ID NO: 11923 - protein, 212 aa, Zea mays
  misc_feature (212)..(212): Xaa can be any naturally occurring amino acid
  unsure (1)..(212): unsure at all Xaa locations
ASSSVSVDQQEAGVRGMAATSRLALALLLAALVAAWQLPAAAVAANYTVGDEKGWNPDVDYTAWVKKHKPFYKGDWLIFEYQNGRSDVVQVDEVGYDNCDKANALSSYSKGHTYAFQLKDAKDYYFICSYGYCYNGMKLHVTAKSSSSSSSSSSGSDSSSSSSDDDSSSPSPPAKKSKAKTSAAPPPSLLAATPMAAAAAAAAALLLNRMLX

SEQ ID NO: 11924 - protein, 156 aa, Zea mays; identical to SEQ ID NO: 10417
  misc_feature (156)..(156): Xaa can be any naturally occurring amino acid
  unsure (1)..(156): unsure at all Xaa locations

SEQ ID NO: 11925 - protein, 372 aa, Zea mays
  misc_feature (372)..(372): Xaa can be any naturally occurring amino acid
  unsure (1)..(372): unsure at all Xaa locations
MSARDRETAEALVRLAASLDGAVLGLGTAAVAVASWVKYLAVSGQLRLVASAATASIADARSLLSGDGAEPRIAAVRGYVRAHDKFFRAPFSGEAGVVTKHTQMCLFTEWRGIFGWTFDLHALLFRSWKEQIVTSFRSVPFVLVSTELGNPTGVVHINVDKADQPLPLTTVFHKLIPLETTPYTLFQTIIGNGYPIALLDEEKILPIGKKITAIGLCQAKDAESVEITSCPEIPFFLSELTKDEMQAQLASRARILFWGSIVLGTLSVCLVGHAIYRGWTRIKLRREARHARQMFEEAEDAIHRDDSSDDDEIGDGQLCVVCLRKRRRAAFIPCGHLVCCSECALTIERTPHPLCPMCRQDIRYMMRVYDSX

SEQ ID NO: 11926 - protein, 527 aa, Zea mays
  misc_feature (527)..(527): Xaa can be any naturally occurring amino acid
  unsure (1)..(527): unsure at all Xaa locations
LASAPAGRRGRRRGFSFPGAGRRLKIPSSPVVLSSGGRGPSIMGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRGKSTDEMKKGAFDAASLQRLVNGKSDGGVTPLHLAALHGHAESVQLLLDLGASVSEVTVNDGSTIDLIGSGSTPLHYAACGGSAVCCQLLIAAGANMGAQNVNGLTPLLVARSWHKTSIEGILSKQPENRMRILPSPYLCLPLMSIVKIARECGWRKTSASSTCQDPCVICLEVECTVAAEGCGHEFCTKCALYLCSTTSSSTSTRGVPGSISCPLCRHAIVSFMRLTSTTPIKELPWTSASLALCAAGSNTGRPEHGGSLHRRPDLRRLRSISVQLGCSSFRSIGSGKLSSMKLNCTGAEEAVPCLVSCLRPDVQRSSSYRGRIRRYSEFX

SEQ ID NO: 11927 - protein, 313 aa, Zea mays
  misc_feature (313)..(313): Xaa can be any naturally occurring amino acid
  unsure (1)..(313): unsure at all Xaa locations
ETTAEPNRTSARGRREREAGSKTMEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWNDHWIFWVGPFIGAALAAIYHQVIIRAIPFKSRSX

SEQ ID NO: 11928 - protein, 321 aa, Zea mays
SASSFIQAPLTTLLEYSGILRPDPGGGTQQDGAGAGPGEVSIRIVAPGEAGTSSERPEEVIVEEEEEDGHATRTRPEDPSPAAGGGEGGRESSSSYQRYDIQQVARWVEQILPFSLLLLVVFIRQHLQGFFVTIWIAAVMFKSNDILRKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHCGSYATSEQ

SEQ ID NO: 11929 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11930 - protein, 687 aa, Zea mays; identical to SEQ ID NO: 10150
  misc_feature (687)..(687): Xaa can be any naturally occurring amino acid
  unsure (1)..(687): unsure at all Xaa locations

SEQ ID NO: 11931 - protein, 264 aa, Zea mays
  misc_feature (264)..(264): Xaa can be any naturally occurring amino acid
  unsure (1)..(264): unsure at all Xaa locations
MAPGGSGERWSLAGATALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGAX

SEQ ID NO: 11932 - protein, 438 aa, Zea mays
  misc_feature (438)..(438): Xaa can be any naturally occurring amino acid
  unsure (1)..(438): unsure at all Xaa locations
MDAASRPPPPHGAGVRVRAPLVESVSCYCRLDTGLKTVVEARKFVPGAKMCMQPEVKQNKRKSRGSKKERCRTQAPLLPGLPDDLAIACLIRVPRLEQPKLRMVCKRWNRLLSGNYFYSLRKKIGVAEEWVYVFKRDREGKISWYAFDPLHQLWKSLPPVPQEYSEALGFGCAVLSGCYLYLFGGKDPLRGSMRRVVFYNARTNKWHRAPDMMRKRHFFGSCVINNCLYVAGGECEGIQRTLQSAEVYDPNRNRWACVTEMNNGMVPFIGVVYDGKWFLKGLDSHRQVTSEVYLPSSNTWSAIDDEMVTGWRNPSISFNGRLYSADCRDGCKLRVYDENTGTWTRFMDSKHHLGSSRAFEAAALVSLNGKLCVIRNNMSITLVDVSNPTMSVETDSARMWETVVRKGQHRSFVANLWSSIAGRNLKSHIIHCHVLQVX

SEQ ID NO: 11933 - protein, 448 aa, Zea mays
  misc_feature (448)..(448): Xaa can be any naturally occurring amino acid
  unsure (1)..(448): unsure at all Xaa locations
MASSLAPASWALPLQMGGAGAAAAGPSCRATLAVVTEPRWAASLRRARVLVALAPRCVALDGPGASGEEEAPKIEDERKKSGETKKPARGRPVWSRILFASKKTRSIIILNALTVIYASDIPVLKEVEALTEPAVFNMVRFVVAAIPFVPFALRSFGDRSVRYAGLELGVWVSLAYLSQAIGLLSSDAGRASFITAFTVVVVPLIDGLLGASIPRLTWFGAIMSLFGIGLLECGGSPPSVGDILNFFSAVFFGIHMLRTEQISRSTDKKKFLALLGFEVLVVAFSSVLWFMFKDGYVDTSGSSFESWTFGMLWDTTVSFPWIPALYTGVLSTVLCMWAEMVAMGDVSATETAVVYGLEPVWGAAFAWFLLGERWDDAAWTGAALVLCGSLTVQLFGSAPEKSKKVKKRSSNALETPVKRRDYLSLSPIPVDSGKIIGRQLERKNKAVX

SEQ ID NO: 11934 - protein, 496 aa, Zea mays; identical to SEQ ID NO: 4917

SEQ ID NO: 11935 - protein, 493 aa, Zea mays
  misc_feature (493)..(493): Xaa can be any naturally occurring amino acid
  unsure (1)..(493): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSMX

SEQ ID NO: 11936 - protein, 220 aa, Zea mays
  misc_feature (220)..(220): Xaa can be any naturally occurring amino acid
  unsure (1)..(220): unsure at all Xaa locations
PPRNWKLRFNLPYSSAASNTADAAAAGGSLDVLLCSHLVSAQELFTMARVYVGNLDSRVTSGELEDEFRVFGVLRSVWIARKPPGFAFIDFDDRRDAEDAIRDLDGKNGWRVELSRNSSGRGGRDRYGGSESKCYECGETGHFARECRLRIGSGGLGSGRRRSRSRSRSRSRSRSRSRSRSPRYRRSPSYSRRSYSPRYRSPRRRSPSPTRARSYSRSPX

SEQ ID NO: 11937 - protein, 430 aa, Zea mays
  misc_feature (430)..(430): Xaa can be any naturally occurring amino acid
  unsure (1)..(430): unsure at all Xaa locations
RRSSRAPATAMAARVLPPPLTLVLLLLLLPLSARDTVAAGEDFPRDGRVIDLDESNFEAALGAIDFLFVDFYAPWCGHCKRLAPELDEAAPMLAGLSEPIVVAKVNADKYRKLGSKYGVDGFPTLMLFIHGVPIEYTGSRKADQLVRNLKKFVAPDVSILESDSAIKNFVENAGTSFPMFLGFGVNDSFIAEYGRKYKKRAWFAVAKDFSEDVMVAYEFDKVPALVAIHPKYKEQSLFYGPFEENFLEDFVRQSLLPLVAPINTETIKMLNDDQRKVVLTIMEDDSDENSTQLVKILRSAASANRDLVFGYVGIKQWDEFVETFDVSKSSQLPKLLVWDRDEEYELVDGSERLEEGTDQASQISQFLEGYRAGRTTKKKISGPSFMGFLNSLVSLTSLYILIFVIALLFVMVYFAGQDDTPQPRRIHEEX

SEQ ID NO: 11938 - protein, 528 aa, Zea mays; identical to SEQ ID NO: 10213
  misc_feature (528)..(528): Xaa can be any naturally occurring amino acid
  unsure (1)..(528): unsure at all Xaa locations

SEQ ID NO: 11939 - protein, 219 aa, Zea mays
KINRQVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFIPWKLQQSQPCRSGSLP

SEQ ID NO: 11940 - protein, 178 aa, Zea mays
  misc_feature (178)..(178): Xaa can be any naturally occurring amino acid
  unsure (1)..(178): unsure at all Xaa locations
KLKAKIETIQKCHKHLMGEDLESLNPKELQQLEQQLDSSLKHIRSRKSHLMAESISELQKKERSLQEENKALQKELAERQKAVASRQQQQQQQVQWDQQTHAQAQTSSSSSSFMMRQDQQGLPPPHNICFPPLTMGDRGEELAAAAAAQQQQPLPGQAQPQLRIAGLPPWMLSHLNAX

SEQ ID NO: 11941 - protein, 508 aa, Zea mays
  misc_feature (508)..(508): Xaa can be any naturally occurring amino acid
  unsure (1)..(508): unsure at all Xaa locations
PIPSARPLDVIPPAAMDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFNLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSMX

SEQ ID NO: 11942 - protein, 589 aa, Zea mays
  misc_feature (589)..(589): Xaa can be any naturally occurring amino acid
  unsure (1)..(589): unsure at all Xaa locations
MQAPEQQPQQQQQRRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEILTGKPLFPGKNVVHQLDLMTDLLGTPSLDTVSRIRNEKARRYLSSMRKKQPVPFTEKFPKADPAALKLLQRLLAFDPKDRPTAEEALADPYFKGLAKVEREPSCQPITKMEFEFERKKATKEDVKELIFREILEYHPQLLKDYMNGTEKTNFLYPSAVDHFRRQFANLEENGGKSGAHAASSDRKHVSLPRTTTVHSNPIPPNGTSQVPQKIPTGRPGRVVGPVIPFENAAAVDPYSQRRVSRNPVLPPTTSNMSAYAYHRKSDNSDRELQQELEKDRMQYQPAQRFMDAKVVSQMSPDLRSSYYIPKGVPKADPADRTALHSSMIHGIAPFSGIAAVGGGYNKVNAVQYGVSRMYX

SEQ ID NO: 11943 - protein, 198 aa, Zea mays
  misc_feature (198)..(198): Xaa can be any naturally occurring amino acid
  unsure (1)..(198): unsure at all Xaa locations
PGPASETTPPIHSPALPRRPSSPPPAHPPVPSCSPMAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKALX

SEQ ID NO: 11944 - protein, 546 aa, Zea mays
  misc_feature (546)..(546): Xaa can be any naturally occurring amino acid
  unsure (1)..(546): unsure at all Xaa locations
SLSVARRAPPPPTQRAPPQISATDAPAMEYERIEKPFPVQGGGFSPKRLRAMLLGVDKRRKGQDGAAEEDEDGGGGGDYGALPKAHARSGAGDGGGATCEEYKDVDVVSTTSEFSSSLETAGGHRPRDAHPVATGSRTRVPPEEDSCDSESVASNFEFHKERRAAAAASVVPPFSKPAPSKWDDAQKWIASPTANCPGRGGAAPAPKKTEKPGSGIGRLPLPATKVVVEATEEIDTKRMDPSQEKREIGWQKAARWAPPDPCPEVEPCPTKTTLLAVETTVAAASAAAVNFNRHDASTTLQSAATCIPPPTTVRSVSMRDMGTEMTPIASQEPSRTGTPVRATSPNCSQPTTPRRTLGGPSAVGSFISHGGECSSSELSEQELQTKTRREIMLLGTQLGKTSIAAWASKKEEEKDASLSLKPVPMDQSTQNITAIRAAAWEEAEKAKYLARFKREEIKIQAWEDHQKAQIEAEMRKIEVEVERMRARAQDKLMTKLASARHSADEKRATAELKRNRAAARTAEQAEHIRRTGRVPPSFGCWNWCSX

SEQ ID NO: 11945 - protein, 447 aa, Zea mays; identical to SEQ ID NO: 9893
  misc_feature (447)..(447): Xaa can be any naturally occurring amino acid
  unsure (1)..(447): unsure at all Xaa locations

SEQ ID NO: 11946 - protein, 476 aa, Zea mays
  misc_feature (476)..(476): Xaa can be any naturally occurring amino acid
  unsure (1)..(476): unsure at all Xaa locations
MAGEQAPEGSGTSRRMDLNLYLGLPPLPRPPVWLGTAMIAPTLMPNSTAPEAPRTGEPDESLAPAAAAYSPSNALSTPEEQPMLDPIVYSWLDGNSTDGEEHTDASEPGPVDGVNVPRSQLLVAATGLEGDDIPVVRFLRPSQVAAGGMEMVSTSILRRSNQGAAAIESGTPELRFQRVIQISQQHSIVRPASANHSQGAASTDADRLVWAIQRTHNSYEAARRQKLDGDNKVCGNSAAKKDGSCDCNSSFECNICLDPAKEPVVTPCGHLFCWPCLYQWLHAHSLHSECPVCKGEVLEVNVTPIYGRGGEEGDSTNPDLPPRPRANRRESLSQQLQMADTRGIATVVRQLIQNQGIVRGLPSSTGIEMTVVTTGRQRARARRPQRQDNNASPSIHVAAQNMGNVASESSNQIQLPHSNGDNAAQMVLASPQQSSSVEQLSTSSTTALIVGEPRSTRRLRPLESPTIRRTRRRPLX

SEQ ID NO: 11947 - protein, 401 aa, Zea mays
  misc_feature (401)..(401): Xaa can be any naturally occurring amino acid
  unsure (1)..(401): unsure at all Xaa locations
MEAPRPNNGRKRKPTPPAGLGALHDDLLERVLARLPPATYFRLRAVCSRWRAAAASPTFLHACARVPSRDPWFLMLSDSDSGPRPPVAFDAAGRSWNRCHAAPGAAVPVAASAGLVLYRAPATGALTVANPLTGASRALPSPPQQAARQLQAIAMYGAGGPYRVALFAGDLPDDLSMAVYDSSSNSWEGPLPLARKPGDDSCPDAPAPDDTVYFLSKSGDVVATNMQRSASKQYSSSVVVRRDGDGDAAFAYFLSYSGTVVACDTARRTFAELPRILPVYFEYSIDVVACGAAAYAVVLSEYLGTASLRVWEFAGGAWRQVAAMPPAMSHGFHGTRPDINCVGHGDRLMVCVTSAEANACFMCDVASNQWEELPKYVNADGEASEFLAAFSFEPRVEVTVX

SEQ ID NO: 11948 - protein, 767 aa, Zea mays
  misc_feature (767)..(767): Xaa can be any naturally occurring amino acid
  unsure (1)..(767): unsure at all Xaa locations
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWLX

SEQ ID NO: 11949 - protein, 690 aa, Zea mays
  misc_feature (690)..(690): Xaa can be any naturally occurring amino acid
  unsure (1)..(690): unsure at all Xaa locations
SILLGGWVSRPVSMRPEERDAAVGRVRDQFPVGMRVLAVDDDPVCLKVLENLLRRCQYHVTTTNQAVVALSMLRQNRDLFDLVISDVHMPDMDGFKLLELVGLEMDLPVIMLSVNGETKTVMKGITHGACDYLLKPVRLEELRNIWQHVVRRKFSNCDRANIDGYEECNRPSNADFDLAHSQITAGPPDQSGRPSKKRKEYHSEEEDEGEESNGQDNDDPSAPKKPRVVWSVELHRKFVAAVNQLGIDKAVPKRILELMNVERLTRENVASHLQKYRLYLKRLSAVASQQASIVAALGGNDPFMRMSAFEGLHGYQSFVSSAALPSFSPQGLLNRNNPASFAIQGVSASRPIQIATGNTTMSHSIGDQNNKYHLSLPGTSCLQGNLAQGLPTPVGQVQLPQKWIHEETGDLSTILSASGRANNGVPGTLQSVTNSHLLQQGFVERRQEKVVIQPSSSASSDRPEGTVGVSSSLMDSCATQQRVVPLSAFSSSASPMNGSFCSNGVAELGATSSGGTSIFPSNDLRIERDSKVGASSFGSVILLSPDTVPNQKYLNFGGESDLRSNMDGGNAGNLLNPKLLWSCLPASQPPNLIGSHHPMSQRLNLGGSMVRQTTASASAAAPQTRIDMFISGDAPKSASDLSFPKVHSELSSSSCSFDGLLNSIIKVEKDDASFSDDLGCDLYSLGACIX

SEQ ID NO: 11950 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11951 - protein, 376 aa, Zea mays
METRDTDATPLPYSYTPLPAADAASAEVSGTGRTRSRRRPLCAAALVLSAALLLAVAALVGVGSRPGAVGMTESAASSPTPSRSRGPEAGVSEKTSGASDDGGRLRGAGGNAFPWSNAMLQWQRTGFHFQPQKNWMNDPNGPVYYKGWYHLFYQYNPDGAIWGNKIAWGHAVSRDLIHWRHLPLAMVPDQWYDTNGVWTGSATTLPDGRLAMLYTGSTNASVQVQCLAVPADDADPLLTNWTKYEGNPVLYPPPGIGPKDFRDPTTAWIDPSDGAWRVVIGSKDDDGHAGIAVVYRTTDLVHFELLPGLLHRVDGTGMWECIDFYPVATRGRASANGVDMSDAIASNGAVAGDVLHVMKASMDDDRHDYYALGRYD

SEQ ID NO: 11952 - protein, 316 aa, Zea mays
  misc_feature (316)..(316): Xaa can be any naturally occurring amino acid
  unsure (1)..(316): unsure at all Xaa locations
DTGVQTPQQFRLPRTKEVIVNGISVRVKYCDTCMLYRPPRCSHCSICNNCVERFDHHCPWVGQCIGLRNYRFFYMFVFSTTLLCLYVFAFCWVYVIKIRAAEQSSVWKALLKTPASVALIIYCFLCVWFVGGLSVFHLYLMSTNQTTYENFRYRYDRRDNPYNKGVLNNFLEIFCTAIPPSKNNFRARVTAGQGLQQTRSQSRGFMSPSMGKPIGDLEMDRKPVAPWDEPRTAADIRDLEAGLGVMFDEKEGRVAHASPDLSRDLPAEFVEGRSGMHSRQSSWVQRGDAIEASAVQMANARTTEASNNVAWSGTHX

SEQ ID NO: 11953 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11954 - protein, 322 aa, Zea mays
  misc_feature (322)..(322): Xaa can be any naturally occurring amino acid
  unsure (1)..(322): unsure at all Xaa locations
ATHWCYACRRPIRLRGQDIACPNCNDGFIQEISEMGGILNTYGLIEPDFEERRARRFGMMDAMSSLMRQRMEEMGRDGLFDIRGRQGTGTEYGRRPTAVPTLVFGGIPSPGVDSGDVNVVLRGGRRVGAAQPNFSSLVVGPSLEALFEQLLLQNNRQGPAPAPQSAIDSMPVVKINRRHLDDDPQCAVCKDKFEVGAEAREMPCKHLYHTDCIIPWLVQHNSCPVCRHPLPSQRSGSTSSARPSAYYNEAADPPGVTRADLEPAPRDGGRESQERRRSFSFLWPFGPSSSRSSSYQYEQNVDEPAVYDPNQIAYSEWHYDHX

SEQ ID NO: 11955 - protein, 430 aa, Zea mays
  misc_feature (430)..(430): Xaa can be any naturally occurring amino acid
  unsure (1)..(430): unsure at all Xaa locations
TFLPQSLFPPFHPFTPTAHLVCHPLCYAPLALSPRRPRPWSSSIESSEPGAPGATIRTRARKGGERAESEPRHKLGTRQDSRPDLLRNMELDSIECMSYSDSMGDDDTDAVTSSQLPRPFLKSSSTAGTAAVNVVVVSDRVGAAGPVAGAGSLVISPATGVHELLECPVCTNSMYPPIHQCQNGHTLCSTCKTRVHNRCPTCRQELGDIRCLALEKVAESLELPCKYYSLGCSEVFPYYSKLKHESQCNFRPYNCPYAGSECSVVGDISFLVAHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFSX

SEQ ID NO: 11956 - protein, 297 aa, Zea mays
  misc_feature (297)..(297): Xaa can be any naturally occurring amino acid
  unsure (1)..(297): unsure at all Xaa locations
MGAVASSAGGARGGDGTVLGDLPENCVAEVLLRLDPLEICRLARLSRTFRGAASGDGVWESKLPRNYARLLAVAAAGDGEGGQAAASAPGAELLPKKELYARLCRRNRFDGGKKEFWLDKGGGGLCMSISSRALSITGIDDRRYWNFIPSDESRFRTVAYLSQIWWFEVRGEVEFFFPEGTYSLFYRIHLGRPFKRLGRRVYSSEHVHGWDMKPVRFQMSTSDGQHVQSKCYLSDPGIWINHHVGDFVVKDSSRPVNIRFAMIQIDCTHTKGGLCVDSVVVKPQHLAQKKAPWTYVX

SEQ ID NO: 11957 - protein, 555 aa, Zea mays
  misc_feature (555)..(555): Xaa can be any naturally occurring amino acid
  unsure (1)..(555): unsure at all Xaa locations
MADTPTSRMVHPFGDVPRQTPKQFLYSGNPQHLCHPYQSAPDTHVVPQRRYTVRSQSHSPNNAGSQDHETHKQYTLESSAASGCSRHGSPSSQSVHAGSGSPVSHDDSHSGSTNGHGSPVSASCVTGEDPTDLKQKLKDLEAVMLGTSETDPEIVNSLEISAANQLSLEPEEWEHMVSMPRGNLKELLIACARAVERNNSYAIDLMIPELRKMVSVSGEPLERLGAYMVEGLVARLAASGSSIYKALKCKEPRSSDLLSYMHFLYEACPYFKFGYMSANGAIAEAIKGEDRIHIIDFHIAQGAQWVSLLQALAARPGGPPFVRVTGIDDSVSAYARGGGLELVGRRLTHIAGLYKVPFQFDAVAISGSEVEEEHLGVVPGEAVAVNFTLELHHIPDETVSTANHRDRILRLVKGLSPKVLTLVEQESNTNTAPFAQRFAETLDYYTAIFESIDLALPRDDRERINIEQHCLAREIVNLVACEGEERVERHEVFGKWKARLMMAGFSPSPLSALVNATIKTLLQSYSPDYKLAERDGVLYLGWKNRPLIVSSAWHX

SEQ ID NO: 11958 - protein, 197 aa, Zea mays
MAGMLPGVECARRRRVRQGGAGMGAEAAGGGTGRRSSFCLYAAGHGGAGNSGKRSGGVVHGHGWTLDSNAREAKERLDQKLRTKREAAIKRHHSTGSIKLGVPHRSAGADERGESSAPAMAGVQREVYSKKGVMRRLMRWSRPRWAAAEQAECAVCLDEFRAGDVLAHLRCGHRFHWACALPWLEGTSRCPFCRAAV

SEQ ID NO: 11959 - protein, 518 aa, Zea mays
  misc_feature (518)..(518): Xaa can be any naturally occurring amino acid
  unsure (1)..(518): unsure at all Xaa locations
PPQTTTTTTENESQNSTAAAAMVLSHASSGRDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYRNIMQNCQDNAAILREGIAATGRFGVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVCX

SEQ ID NO: 11960 - protein, 493 aa, Zea mays; identical to SEQ ID NO: 11935
  misc_feature (493)..(493): Xaa can be any naturally occurring amino acid
  unsure (1)..(493): unsure at all Xaa locations

SEQ ID NO: 11961 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11962 - protein, 263 aa, Zea mays; identical to SEQ ID NO: 10647
  misc_feature (263)..(263): Xaa can be any naturally occurring amino acid
  unsure (1)..(263): unsure at all Xaa locations

SEQ ID NO: 11963 - protein, 473 aa, Zea mays
MASQGEPSSSDPKGKKDYSTAILERKKSPNRLVVDEATNDDNSVVALHPDTMERLQLFRGDTVLLKGKKRKDTICIVLADETCEEPKVRMNKVVRKNLRVRLSDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVSNDHFKTALGTSNPSALRETV

SEQ ID NO: 11964 - protein, 438 aa, Zea mays
  misc_feature (438)..(438): Xaa can be any naturally occurring amino acid
  unsure (1)..(438): unsure at all Xaa locations
SMPPSLFTPRFRFSSAPVPEPLLGLIDLGASRDLSGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPYX

SEQ ID NO: 11965 - protein, 578 aa, Zea mays
  misc_feature (578)..(578): Xaa can be any naturally occurring amino acid
  unsure (1)..(578): unsure at all Xaa locations
MAQACKKRRGVYISSESGDSDTDSDVEGSKHSQKSGVTSISTCEHQSSYNLKAASMKSSRMIRLCGNIVRKLIDHKCGWLFKEPVDPDLYGIPDYFDVIRSPMDLGTIKNKLTKKKYVSIEEFAADVRLTFSNAMKYNPPGNDVHIFAKELNEMFDSEWESVERKFRGRNLGQDQQTMKAIKVRAMMDSKSTVARGPVACSNPKTLVTRGPVACSNSIAKKTLTDALSSKVKIKFSVRSSAHTSSKDILVQAAGSKEGSLNHSVPTGNKEASSNCTIPIAKEAKISRAREIERCSGSIGKQSWSCNDTSTSPLASSVQGEESYLHDEPLSPSRALRAAMLRSRFAGTIVKAQQKALLDHGKNIDPVKLQLEKERLEKRQQEEKARIEAQVKAAEAAAQQKFEEEMRMKRKQEREAARLALRMMKKTVDIDNSDFLKELENFSKTWQANPPGKLIVDFISGDLPPGLGSPLERLGLFMKEDFEDEVEQEMEDRVSPSMDVDIRKDFQEDLGHEMQDSASPVTVIGTKNDVQGVAGHEMEDSGSPATVIDTKKEETEHEMVDSVSPLMDVDTEEGEISCX

SEQ ID NO: 11966 - protein, 541 aa, Zea mays
  misc_feature (541)..(541): Xaa can be any naturally occurring amino acid
  unsure (1)..(541): unsure at all Xaa locations
KGKARRRMAGGGAATPPKQEELQPHPVKDQLPSVSYCITSPPPWPEAVILGFQHYIVMLGTSVIIPSALVPQMGGGNEEKARVIQTLLFVAGINTLCQSFFGTRLPAVMGGSYTIVAPTISIIMAGRYSNEADPREKFLRTMRGTQGALIIASTIQIVLGFSGLWRNVVKLLSPLSAVPLVSLAGFGLYELGFPGVAKCVEIGLPEIILMLIFSQYLPHAVHAAKPVFDRFSVIFTIAIVWLYAYILTVSGAYKNARTKTQLHCRVDRSGLVGGAPWISVPYPFQWGAPTFDAGESFAMMVAAFVALVESSGAFIAVSRYASATMIPPSVLGRGIGWQGIGTLLGAFFGTANGTAVSVENAGLLALTHVGSRRVVQISAGFMIFFSVLGKFGAIFASIPLPIFAALYCILFAYIGACGLSFLQFCNLNSFRTKFIMGFSLFMGLSVPQYFNEYTSVAGYGPVHTGARWFNDMINVPFSSKPFVAVLVAFLLDNTIQVRDSGVRRDRGYHWWDKFRSFKTDSRSEEFYSLPFNLNKFFPSVX

SEQ ID NO: 11967 - protein, 260 aa, Zea mays
  misc_feature (260)..(260): Xaa can be any naturally occurring amino acid
  unsure (1)..(260): unsure at all Xaa locations
MRIQCDACEAAAATVVCCADEAALCARCDVEIHAANKLASKHQRLPLGDAAALPASLPRCDVCQERPAFIFCVEDRALLCRDCDEPIHVPGTLSGNHQRYLATGIRVGFSSVCGASAEGLPPAPPKGSSKPAAVVSAPAAGTTTKTRTVKDALPQEVPSSPFLPPSGWAVEDLLELSDYESSDKKDSSLGLKELEWFEDIDLFHAHSPAKTAMAEFFASPQPVSNAGFYKANGARLFKKSRMEVPDDDDEDYFIVPDLGX

SEQ ID NO: 11968 - protein, 245 aa, Zea mays; identical to SEQ ID NO: 10657
  misc_feature (245)..(245): Xaa can be any naturally occurring amino acid
  unsure (1)..(245): unsure at all Xaa locations

SEQ ID NO: 11969 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11970 - protein, 216 aa, Zea mays
  misc_feature (216)..(216): Xaa can be any naturally occurring amino acid
  unsure (1)..(216): unsure at all Xaa locations
MAHPRSVAAAAPLLLLLAAAAAAAAGLVSAASPAASDFVRKSCRTTQYPSVCEQSLASYGGSPPPRSPRELARAALSVSADRARAASAYVGRLCGASNGKGAKKGSGSASASASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGYX

SEQ ID NO: 11971 - protein, 546 aa, Zea mays
  misc_feature (546)..(546): Xaa can be any naturally occurring amino acid
  unsure (1)..(546): unsure at all Xaa locations
MSSEPPPAPSAAAAEGLAADLSAATLSKKQQKKDARKAEKAEKAAQRQQQQQPADAEDPFAANYGDVPVEEIQSKAISGRLWSQIGDLDDSSAGRSVLIRGSLQAIRPVSKKMAFVVLRQSMSTVQCVLVASADAGVSTQMVRFATALSKESIVDVEGVVSLPKEPLKATTQQVEIQVRKIYCINRAIPTLPINLEDAARSEADFEKAELAGEKLVRVGQDTRLNYRAIDLRTPSNQAIFRIQCQVENKFREFLLSKDFVGIHTPKLISGSSEGGAAVFKLLYNGQPACLAQSPQLHKQMALCGGFERVFEVGPVFRAENSNTHRHLCEFVGLDAEMEIKEHYFEVCDIIDGLFVSIFKHLTENCNKELETINRQYPFEPLKYLDKTLKLTYEEGVQMLKEAGTEIEPMGDLNTEAEKKLGRLVREKYDTDFFIMYRYPLAVRPFYTMPCYDNPAYSNSFDVFIRGEEIISGAQRIHTPELLTKRATECGIDVSTISTYIEVFSYGAPPHGGFGVGLERVVMLFCALNNIRKTSMFPRDPQRLVPX

SEQ ID NO: 11972 - protein, 814 aa, Zea mays
  misc_feature (814)..(814): Xaa can be any naturally occurring amino acid
  unsure (1)..(814): unsure at all Xaa locations
GTDNSSFFKEKLTQALRYFKESTDQHLLVQVWAPVKNGDRYVLTTSGQPFVLDHQSIGLLQYRAVSMMYMFSVDGENAGDLGLPGRVYKQKVPEWTPNVQYYSSGEYQRLNHAISYNVHGTVALPVFDPSAQSCIAVVELIMTSKKINYACEVDKVCKALEAVNLKSTEILDHPNVQICNEGRQAALVEILEILTVVCEEHKLPLAQTWVPCKYRSVLAHGGGLKKSCLSFDGSCMGEVCMSTSDVAFHVIDAHMWGFRDACVEHHLQRGQGVSGKAFISHKPCFSKDIRKFCKLAYPLVHYARMFGLSGCFAICLQSSYTGNDDYILEFFLPLDCIDEDDQNALLESILTLMKRCLRSLKLVDDNDLSGVSLHLSNVLKLENEESKTDAQFDGSLRESPEDDRHGGSHKFDNENQKVLDITEGQLLTDDYSQDNGTSVGRPNGSGASDSSLLHKTNKPPERRRGKAEKTISLEVLQQYFSGSLKNAAKSLGVCPTTMKRICRQHGISRWPSRKINKVNRSLSKLKQVIESVQGSDAAFNLTSITGPLPIPVGPSPESLNVEKLTQSKVAELSNLAVGVDRDSLQKSLENDDHFDIVMAQQGFIDNNNDVQLEADKASHSRSSSGEGSINSRTSEGSCQGSPANQTFVCKPIASMFAEPQLNQEEFNKEPFQEPQLPLSRMLIEDSGSSKDLKNLFTSTSDQPFLAPPNNLVSMKHSGTVTIKASFKEDIVRFRFPCSGGVIVLKEEVAKRLRMDVGTFDIKYLDDDHEWVKLACNADLEECMEISRLSGSHVIRLLVSDIAAHFGSSCGSSGX

SEQ ID NO: 11973 - protein, 749 aa, Zea mays
  misc_feature (749)..(749): Xaa can be any naturally occurring amino acid
  unsure (1)..(749): unsure at all Xaa locations
GLCRFSVQELSARGPYHVARVSRLDMTKTELEQAEQDPDLIALSRQFKATAMELISVLEQKQKTVGRTKVLLDTVPVYRLADIFVASFEISFEEQLSMLDSVHLKVRLSKATELVDRHLQSILVAEKITQKVEGQLSKSQKEFLLRQQMRAIKEELGDNDDDEDDVAALERKMQNAGMPANIWKHAQREMRRLRKMQPQQPGYSSSRAYLELLADLPWQKVSEERELDLRVAKESLDQDHYGLTKVKQRIIEYLAVRKLKPDARGPVLCFVGPPGVGKTSLASSIAKALNRKFIRISLGGVKDEADIRGHRRTYIGSMPGRLIDGLKRVSVSNPVMLLDEIDKTGSDVRGDPASALLEVLDPEQNKAFNDHYLNVPFDLSKVIFVATANRMQPIPPPLLDRMEIIELPGYTPEEKLKIAMKHLIPRVLEQHGLSTTNLQIPEAMVKLVIERYTREAGVRNLERNLAALARAAAVKVAEQVKTLRLGKEIQPITTTLLDSRLADGGEVEMEVIPMEHDISNTYENPSPMIVDEAMLEKVLGPPRFDDREAADRVASPGVSVGLVWTSVGGEVQFVEATAMVGKGDLHLTGQLGDVIKESAQLALTWVRARAADLNLSPTSDINLLESRDIHIHFPAGAVPKDGPSAGVTLVTALVSLFSNRKVRADTAMTGEMTLRGLVLPVGGVKDKVLAAHRYGIKRVILPERNLKDLSEVPLPILSDMEILLVKRIEEVLDHAFEGRCPLRSRSKLX

SEQ ID NO: 11974 - protein, 117 aa, Zea mays
  misc_feature (117)..(117): Xaa can be any naturally occurring amino acid
  unsure (1)..(117): unsure at all Xaa locations
MYCRKLIISYCFQVAGHHQNEEFSVRGKEPKDEVQIYTWKDATLRELTDLVKEVALPARKRNARLSFAFVYPDKNGRFVVRQVGSTFAYGHGRGDDAKTLAELGFQIGDYLSVAIMX

SEQ ID NO: 11975 - protein, 153 aa, Zea mays
MGISSMPEPRDSLLGYLVYNTVISIAALAGLVRAALVFLDLQAALPPGDDGGDQLAASGPGLAERFLRAFRPALYEVLASTATTCEADGGGDDCSVCLAGFRARAVVNRLPCGHLFHRACLETWLRYERATCPLCRAHVPLPADETPLLRYPE

SEQ ID NO: 11976 - protein, 307 aa, Zea mays
EIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKS

SEQ ID NO: 11977 - protein, 248 aa, Zea mays
  misc_feature (248)..(248): Xaa can be any naturally occurring amino acid
  unsure (1)..(248): unsure at all Xaa locations
ALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGAX

SEQ ID NO: 11978 - protein, 615 aa, Zea mays
  misc_feature (615)..(615): Xaa can be any naturally occurring amino acid
  unsure (1)..(615): unsure at all Xaa locations
SSPFSWRRRRQRPSPPLPLCFAWAVQLAGDGSDVGENRAAVAVEAIWPYPRRRRHGVRIRLRLRGARRGRRRVIPRGSRIRASSSSPATHRRPQDARDGTAATSLSSGLDWFRLLLAPGRTLDMDFFTEYGEASQYQIQEVIGKGSYGVVAAAIDSHTGERVAIKKINDIFGNVSDAARILREIKLLRLLRHPNIVQIKHIMLPPTRREFKDIYVVFELMESDLHQVIKANDNLTPEHHRFFLYQLICALKYMHSAHVFHRDLKPRNILANSDSKLKICDFGLARASFNDSLSAIYWTDYVATRWYRAPELCGSFFSSYTPAIDIWSIGCIFAEVLTGTPLFPGRNVVHQLDLITDLLGTPSFRSLSQIHSDKAREYLLGMPRKRPIPFSHKFHNADPLALRLLERLLAFDPKDRPTAEEALADPYFSGLSKLELEPSAQPISKVDFEFEGRKLTKAGVREMIYREILEYHPQMLQEYIEGGDQIHFLYPSGVDRFQRQFAHLEENYRRGVASTPPRRQPTSLPRERVCSSEDGHSQDSDSEEQRAASYVARTTISPPRSQEEGGKLQPAYQSAAAAADSCAKSYLKGAASISSASRRTIKGDNGRKEKESPRLX

SEQ ID NO: 11979 - protein, 157 aa, Zea mays
  misc_feature (157)..(157): Xaa can be any naturally occurring amino acid
  unsure (1)..(157): unsure at all Xaa locations
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRYGGGGYGGGGGGYGGGGGYGGGGGGYGGGNRGGGYGNSDGNWRNX

SEQ ID NO: 11980 - protein, 376 aa, Zea mays; identical to SEQ ID NO: 11951

SEQ ID NO: 11981 - protein, 401 aa, Zea mays; identical to SEQ ID NO: 11627
  misc_feature (401)..(401): Xaa can be any naturally occurring amino acid
  unsure (1)..(401): unsure at all Xaa locations

SEQ ID NO: 11982 - protein, 359 aa, Zea mays
  misc_feature (359)..(359): Xaa can be any naturally occurring amino acid
  unsure (1)..(359): unsure at all Xaa locations
WLSSASRSSLGAAVGGEAKVTPEADPAAQPDDADEERWSRLLPELLTEIMRRVDAGAERWPPRRDVVVCACVCRRWRDAAVSVVRPPLECGRITFPSSLKQPGPRDAPMHCFIRRDKKNSTFSLYLSLTQALTDKGKFLLAARRFRQGAHTEYIISYDYDDLHPRSSSYVGKLRSDFLGTKFIIYDSQAPYDGAKPSRTRSTRRFASKQISPQVSGGNFEVGQVTYRFNFMKSRGPRRMQCNIQCPVGQGSASDPPKEKTPSPSSLDLKNKAPRWHDHLQCWCLNFHGRVTVASVKNFQLVATAGSGGPWGVGDEETVILQFGKIEDDAFTMDYRQPLSAFQAFAICLTSFGTKLACEX

SEQ ID NO: 11983 - protein, 975 aa, Zea mays
  misc_feature (975)..(975): Xaa can be any naturally occurring amino acid
  unsure (1)..(975): unsure at all Xaa locations
MVSGHIFHCRKNSWPAEEYVGRTALQLLDFDGGAPPEQAWRRRLNSHANILKEFSVTFMEAMRMMSLGLRLWSYVREEASHGRKAPIDPFTKERCKPSASQGVPLGGMGSGSISRGFRGEFKNWHIIPGLCESSPVMENQFSIFVSRDGGNKKYSSVLAPGHHEGLKKNSDSGISSWDWNLSGQHSTYHALFPRAWTVYDGEPDPDLKISCRQISPFIPHDYKDSSLPTSVFVYTLVNTGRDRAKVSLLMTWANSIGGFSHNSGGHYNEPFIAEDGVSGVLLHHKTAKDNPPVTFAVAACETQNVNVTVLPVFGLSGENHVSAKEMWNTMLQNGHFDRENFSAGPSMPSSPGQKLCAAVSASTWVEPHGRCTVVFALAWSSPKVKFQKGCTYNRRYTQFYGTSEKSAVNLVHDALTKYKLWEEEIEKWQNPILKDERLPEWYKFTLFNELYFLVAGGTVWTDGQPPAIDEKKSPGFNHQKSSKRGTKDTNQGSVKDRHVNLAVEQVPHGGYMANGDDHSVSKFAAVHGSELQEQTNGLKSEEPIPYLISKDGPEHVGKFLYLEGVEYIMWNTYDVHFYASFALLDLFPKIELSIQRDFANAVLYEDRRKVKFLADGTSGIRKAKGAVPHDLGTHDPWHEMNAYNIHDTSKWKDLNPKFVLQIYRDFAATGDMQFGRDVWPAVCAAMDYMDQFDRDGDGLIENDGFPDQTYDAWTVHGISAYCGCLWLAALQAAATMAHRLGDRHFAEKYKLKFIKAKAVYEAKLWNGSYFNYDSGTSSNSRSIQADQLAGQWYAASSGLPPLFDEHKIRTALQKIFEFNVMKVKGGRMGAVNGMTPKGKVDETCMQSREIWTGVTYAVAANMLLHGMEHQGFTTAEGIFTAGWSEEGYGYWFQTPEGWTTDGHYRSLVYMRPLAIWAIQYAVSPPKAILEAPKVNLMDRIHISPHMVRAISEISIRKVAPDNRCLPSSAFHCECX

SEQ ID NO: 11984 - protein, 824 aa, Zea mays
  misc_feature (824)..(824): Xaa can be any naturally occurring amino acid
  unsure (1)..(824): unsure at all Xaa locations
NHYSRARAGTILERLPPRSSVSIPHLMAPALSRTLGPSSVAALRPSPSCRGLLRAALVPQGRGASARCAVGVRWEAARRRRMAGVRCDAAVAEKPAGEEETAGEKYEYQAEVTRLMDLIVHSLYSHKEVFLRELVSNASDALDKLRFLSVTDPSVLADGGELEIRIKPDLEAGTITITDTGIGMTKDELKDCLGTIAQSGTSKFLKALKENKDLGADNGLIGQFGVGFYSAFLVAERVVVSTKSPKADKQYVWEAEADSSSYVIKEENDPEKMLSRGTEITLYLRDDDKYEFADPTRIQGLVKNYSQFVSFPIYTWQEKSRTVEVEEEEESKGEEATEESKSEEATEGEKQKKKKTITEKYWDWELANETKPIWMRNPKEVEKTEYNEFYKKTFNEFLDPLAYTHFTTEGEVEFRSVLYVPGMAPLSNEEIMNPKTKNIRLYVKRVFISDDFDGELFPRYLSFVKGVVDSNDLPLNVSREILQESRIVRIMRKRLVRKAFDMIQEIAEKDGKEDYNKFWESFGKFMKLGCIEDTGNHKRLAPLLRFYSSKNETDLISLDQYVENMPENQKAIYYIATDSLQSAKTAPFLEKLVQKDIEVLYLIEPIDEVAIQNLQTYKEKKFVDISKEDLELGDEDEDKEKESKQEYTLLCDWIKQQLGDKVAKVQISKRLSSSPCVLVSGKFGWSANMERLMKAQTLGDTSSLEFMRGRRIFEINPDHPIIKDLNAACKSEPESTEAKRAAELLYEAALISSGYTPDSPAELGGKIYEMMTMALGGRWGRLETEEAEVIASIDDADSSEGATTTTEVVEPSEVRTESDPWKDX

SEQ ID NO: 11985 - protein, 303 aa, Zea mays; identical to SEQ ID NO: 10256
  misc_feature (303)..(303): Xaa can be any naturally occurring amino acid
  unsure (1)..(303): unsure at all Xaa locations

SEQ ID NO: 11986 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11987 - protein, 336 aa, Zea mays
  misc_feature (336)..(336): Xaa can be any naturally occurring amino acid
  unsure (1)..(336): unsure at all Xaa locations
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRPGQKWHVFYATEYPEQPMVNLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKGGSAX

SEQ ID NO: 11988 - protein, 157 aa, Zea mays; identical to SEQ ID NO: 9958
  misc_feature (157)..(157): Xaa can be any naturally occurring amino acid
  unsure (1)..(157): unsure at all Xaa locations

SEQ ID NO: 11989 - protein, 479 aa, Zea mays
  misc_feature (479)..(479): Xaa can be any naturally occurring amino acid
  unsure (1)..(479): unsure at all Xaa locations
MEVSSVEFGHHAAAASKCFDDDGRLKRTGTMWTASAHIITAVIGSGVLSLAWAIAQLGWVAGPTVMLLFSFVTYYTSALLADCYRSGDACTGKRNYTYMDAVNANLSGVKVWFCGFLQYANIVGVAIGYTIAASISMLAIQRANCFHVEGHGDPCNISSTPYMIIFGVVQIFFSQIPDFDQISWLSILAAVMSFTYSTIGLGLGIAQVVSNKGVQGSLTGISVGLVTPVDKMWRSLQAFGDIAFAYSYSLILIEIQDTIRAPPPSESKVMRRATVVSVAVTTFFYMLCGCMGYAAFGDNAPGNLLTGFGFYEPFWLLDVANAAIAVHLVGAYQVYCQPLFAFVEKWARQRWPKSRYITGEVDVPLPLGTAGGRCYKLSLFRLTWRTAFVVATTVVSMLLPFFNDVVGLLGALGFWPLTVYFPVEMYIVQKKVPRWSTRWVCLQLLSVACLVITVASAAGSVAGIVSDLKVYKPFVTTSX

SEQ ID NO: 11990 - protein, 435 aa, Zea mays
  misc_feature (22)..(22): Xaa can be any naturally occurring amino acid
  misc_feature (32)..(32): Xaa can be any naturally occurring amino acid
  misc_feature (114)..(114): Xaa can be any naturally occurring amino acid
  misc_feature (122)..(122): Xaa can be any naturally occurring amino acid
  misc_feature (148)..(148): Xaa can be any naturally occurring amino acid
  misc_feature (153)..(153): Xaa can be any naturally occurring amino acid
  misc_feature (159)..(159): Xaa can be any naturally occurring amino acid
  misc_feature (171)..(171): Xaa can be any naturally occurring amino acid
  misc_feature (186)..(186): Xaa can be any naturally occurring amino acid
  misc_feature (216)..(216): Xaa can be any naturally occurring amino acid
  misc_feature (229)..(229): Xaa can be any naturally occurring amino acid
  misc_feature (238)..(238): Xaa can be any naturally occurring amino acid
  misc_feature (270)..(270): Xaa can be any naturally occurring amino acid
  misc_feature (274)..(274): Xaa can be any naturally occurring amino acid
  misc_feature (278)..(278): Xaa can be any naturally occurring amino acid
  misc_feature (301)..(301): Xaa can be any naturally occurring amino acid
  misc_feature (321)..(321): Xaa can be any naturally occurring amino acid
  misc_feature (423)..(423): Xaa can be any naturally occurring amino acid
  misc_feature (426)..(426): Xaa can be any naturally occurring amino acid
  unsure (1)..(435): unsure at all Xaa locations
STHASACTWVLQKLERVKMEGXNLLLALGHCXWMVWVIQSVSPSQNHQKKRLILAKGWQILGRRPQTFKLGWPHLKKSTGVILISSVGVVNCLCRRRVRKLTTEMSCIVMVLYXCQFPWISXRLLISFIGLLQQSLWLACLSRIWLLXIPFFXGSSPLXKMLKLGLHSKDXLTSAWAYWPPYRSSXQSHSHMQLYLSTSTNCQVVHTNFCQKALDXLSLFVVMNHTSSXIFLRMLMIXQCCYIMFHMVRRRQAGCMLLGGYLSTYRPMAXTSLXFITXISLKPLTEMVLSLVLGPTLVLSXSMVLVMVYSLKLLTRNLSFXGTHLSTCSKVAGCATQKLNMCLVLPAAEHSLTFRKSALRLEKRPLICQVSRSLSWAVLSMDQERWLMPILGTLEALPERSTFTSARPLCSAPSPWKVPLTPXSSXSRTMADGWI

SEQ ID NO: 11991 - protein, 339 aa, Zea mays
  misc_feature (339)..(339): Xaa can be any naturally occurring amino acid
  unsure (1)..(339): unsure at all Xaa locations
MVGTAEGGAERAVRRWVDAAGGRLVLDGGLATELEANGADLNDPLWSAKCLLSSPHLIRKVHMDYLEAGANIIITASYQATIQGFESKGFSKEQSENLLTKSVQIAVEAREMFLKEHLEKSTPIQHPILVAAALGSYGAYLADGSEYSGDYGEAGTKEFLKDFHRRRLQVLAEAGPDLIAFETIPNKLEAQAYVELLEECNINIPSWLSFNSKDGVHIVSGDSLIECTTIADKCAKVGAVGINCTPPRFIHGLILSIRKVTDKPILIYPNSGERYDGEKKEWVESTGVSDGDFVSYVNEWCKDGAALIGGCCRTTPNTIRAIQRTLNQGCNKHQLPVAX

SEQ ID NO: 11992 - protein, 185 aa, Zea mays
  misc_feature (185)..(185): Xaa can be any naturally occurring amino acid
  unsure (1)..(185): unsure at all Xaa locations
MVGTGKRERIAIRRIDNLAARQVTFSKRRRGLFKKAEELSILCDAEVGLVVFSATGKLFHFASSRQMRGEELQRLSVEQLQELEKTLESGLGSVLKTKSQKILDEISGLERKRTQLIEENSRLKEQVTRMSRMETQLGADPEFVYEEGQSSESVTNTSYPRPSTDTDDCSDTSLRLGLPLFSSKX

SEQ ID NO: 11993 - protein, 338 aa, Zea mays
  misc_feature (338)..(338): Xaa can be any naturally occurring amino acid
  unsure (1)..(338): unsure at all Xaa locations
TNLGFQASEYLPPPADLPASLGLRRFEARAKMPQRHSKNNNDLAFFTYEEKRKLGYGTQRERLGKDSIKPFDACCLCLKPLIGPLCCPKGHTFCKECILECLLSQKKDIKRKLAAHEAQKKQEKEEEEEKLILQKAKELDAFDQQNHGAVPQYHDRSGSQYKNGFHGANSVKVTSFEEEALRNMKAFWLPSATPEATVKVDLPSTDTVCPEGQEKLKLKSLFPISFTEETADQKSSKAGNSCSYMCPSCKSTLTNTMSLVAVSTCGHVFCKKCSDKFLVKDKACLECSKPFRERNLVPLEKGGTGFAAHDERLEARDFKYLGSGSGLGLVKPAPKTYX

SEQ ID NO: 11994 - protein, 810 aa, Zea mays
  misc_feature (810)..(810): Xaa can be any naturally occurring amino acid
  unsure (1)..(810): unsure at all Xaa locations
LDIIPVDKDGGTFQDESPFSSSNVMFGGNLGPKNAIIRPIKLPEVPKLPPYTTWIFLDRNQRMTEDQSVLGRRRIYYDTSCGEALICSDSEDEAIEDEEEKKEFKHSEDHIIRMTVQECGMSDAVLQTLARHMERAADDIKARYEILHGEKTKDSCKKGTEHNVKVEDLYCDKDLDAALDSFDNLFCRRCLVFDCKLHGCSQDLVFPTEKQPAWSGVDDSVPCGIHCHKLASEPDSAAGADHMLFDVEEPTHSSDNVMNQPGSNRKKNGSSGRKTKSQQSESSSTARVISESSDSEVHPISNKSPQHSPSPSKVKIGPKGGIRKITNRRIAERILMSVKKGQREMASSDSNFVSGYLLARDMKLRSDTRNGNKELIVSSQQSSPSTRSSKKKSTPQIGNSSAFAEAHNDSTEEANNRHSATDGYDSSRKEEFVNENLCKQEVYLRSWKAIEQGLLVKGLEIFGRNSCLIARNLLGGMKTCKDVFQYMNYIENNSASGALSGVDSLVKGYIKGTELRTRSRYFRRRGKVRRLKYTWKSAGYNFKRITERKDQPCRQYNPCGCQSTCGKQCPCLSNGTCCEKYCGCPKICKNRFRGCHCAKSQCRSRQCPCFAADRECDPDVCRNCWVGCGDGTLGVPNQRGDNYECRNMKLLLKQQQRVLLGRSDVSGWGAFLKNSVSKHEYLGEYTGELISHKEADKRGKIYDRENSSFLFNLNNEYVLDAYRMGDKLKFANHAPDPNCYAKVIMVTGDHRVGIFAKERILAGEELFYDYRYEPDRAPAWARKPEASGAKDDGQPFNGRAKKLAQNNRGX

SEQ ID NO: 11995 - protein, 257 aa, Zea mays
  misc_feature (257)..(257): Xaa can be any naturally occurring amino acid
  unsure (1)..(257): unsure at all Xaa locations
MSEGKKYLIVLAHHEPKSLNHSFAQRAQQVLTAAGNEVKLIDLHAVNFNPVSDRRNFKTTANPEFLKQQIEERHATEHDGFADDIKESLEAVDWCDVLILQFPFWWFSMPAILKGWIDKVWASGRVYGPNKKFTAGVWKGKKAFLSITTGSSEPTYAGPDSRMGDINSLLFPINHGILAFVGFTVLPPFIAYSASHATEDQRKQFLDEYEQRLLNLENLTPISYPPNEAFDSTGILKADWKAAQAHQNSNPAPREGX

SEQ ID NO: 11996 - protein, 438 aa, Zea mays
  misc_feature (438)..(438): Xaa can be any naturally occurring amino acid
  unsure (1)..(438): unsure at all Xaa locations
AEELREEEEGGGQRKKMGGIPREPSFSRWCRDPSAASASNTAAAAATSDSDASEEFELPLLPSSSGGGGSPMDIEVGATARSDDLPISPRLLAKVIGLIACWYTLSTCLTLYNKEMLGKHMWKFPAPFLMNTVHFTMQAVASRAIVWFQQRGLEGGPSKMSWKDYCLRVVPTALATALDINLSNISLVFITVTFATMCKSASPIFILLFAFMFRLEKPSFSLLGIMLVVSFGVLLTVAKETEFNLWGFMFIMLAAVMAGFRWSMTQILLQKEEYALKNPFTLMSHVAPVMAIVTAIISIVMDPWHDFRASHFFDSSTHIIRSSLLLLLGGALAFFMVLTEYVLVSVTSAVTVTVAGIVKEAVTILVAVLFFNDPFTWLKALGLAIIIFGVSLFNIYKYKRFKKGHHSEDAGTNIQSYNGTSKYVILDDDTEDQDDSGX

SEQ ID NO: 11997 - protein, 322 aa, Zea mays
  misc_feature (322)..(322): Xaa can be any naturally occurring amino acid
  unsure (1)..(322): unsure at all Xaa locations
MAPAVSAAASAAMRQALRDRQILDAVGTGAAALSLAGSSFIVICYLLFRELRKFSFKLVFYLAVSDMFCSLFTILGGPSNAFYCFAHDYSAHFFCVASFLWTTTISFTLHRTVVKHKTDVEEFGSIFHLYVWGTSLSTTVLRSIGSDYGRPGTWCWIQQGSMAKVLHLITFYLPLWGAILYNGFTYYEVNRMLNNATQMAAGISDRSNQSDIRADRKAFNRWGYYPLILIGSWAFATINRLYDFANPGHRIVWLSFLDVGFAGLMGLFNSIAYGLNSSVRRAISERIDTFLPERIKRSLPALSRLRSQQENELTSLIVEGNX

SEQ ID NO: 11998 - protein, 246 aa, Zea mays
  misc_feature (246)..(246): Xaa can be any naturally occurring amino acid
  unsure (1)..(246): unsure at all Xaa locations
GMEKATVSEPEKHGHKEEEHEVGEKKEGLFAKLHRTSSSSSSSSDEEEEAIDENGEIIKRKKKKVGLKEKIKEKLPGHKDGHHTAAPSPAPAPVETHAHHQEEAHHRPHVVPAPAPAPPPHVETHVHQHEHDHGVVVQKVEDDVKTGTPLHAPEEEKKGLLDKIKEKLPGGHKKPEDAAAAAPAPAVHAPAPAPHAENVSSPDGKEKKGLLGKIMDKIPGYHKSSAEEADHKADAAGEHRTSSSNX

SEQ ID NO: 11999 - protein, 357 aa, Zea mays
  misc_feature (357)..(357): Xaa can be any naturally occurring amino acid
  unsure (1)..(357): unsure at all Xaa locations
MGVAGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIKLSLSVLLLGVGVATVTDLQLNVMGSVLSLLAIITTCIAQIMTNTIQKKFKVSSTQLLYQSCPYQALTLFLVGPFLDGFLTNQNVFAFDYTTQVLFFIVLSCLISVSVNFSTFLVIGKTSPVTYQVLGHLKTCLVLTFGYVLLHDPFSWRNILGILIAVIGMVLYSYFCTRETQQKPAEASPQAVQAKEGESNPLISDTLSAAENGGSATDDEPLKVPMWSSKYSKAX

SEQ ID NO: 12000 - protein, 361 aa, Zea mays
PPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHSSFWKGADVLVFNSYLWWVAGDKIQILRGADNDPSKDIVEMKSEEAYRLVLHQVVRWLERNVDPGKSRVFFVTASPTHTDGRAWGDDDAEGSGNCYNQTSPISAASSYRGGTSQEMLRATEEVLATSRVPVGLVNITRLSEYRRDAHTQTYKKQWVEPTAEQRADPRSYADCTHWCLPAVPDTWNELLYWKLFFP

SEQ ID NO: 12001 - protein, 355 aa, Zea mays
  misc_feature (355)..(355): Xaa can be any naturally occurring amino acid
  unsure (1)..(355): unsure at all Xaa locations
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQMSLSVLLLGVGVATVTDLQLNAVGSILSLLAIITTCIAQIMTNTIQKKFKVSSTQLLYQSCPYQSLTLFLIGPFLDGFLTNQNVFAFNYTSQVVFFIVLSCLISVSVNFSTFLVIGKTSPVTYQVLGHLKTCLVLAFGYVLLHDPFSWRNILGILIAVVGMVLYSYFCTVETQQKNVEVSPQQVKESEAGPLIADSMSKVENGGGGVDDEPLKVPMWSSKYSREX

SEQ ID NO: 12002 - protein, 289 aa, Zea mays; identical to SEQ ID NO: 10780
  misc_feature (289)..(289): Xaa can be any naturally occurring amino acid
  unsure (1)..(289): unsure at all Xaa locations

SEQ ID NO: 12003 - protein, 324 aa, Zea mays
  misc_feature (324)..(324): Xaa can be any naturally occurring amino acid
  unsure (1)..(324): unsure at all Xaa locations
MAAGRELVVSFGEMLIDFVPTVAGVSLAEAPAFLKAAGGAPANVAIAVSRLGGGAAFVGKLGDDEFGRMLAAILRDNGVDGDGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLLLIEKAX

SEQ ID NO: 12004 - protein, 510 aa, Zea mays; identical to SEQ ID NO: 11366
  misc_feature (510)..(510): Xaa can be any naturally occurring amino acid
  unsure (1)..(510): unsure at all Xaa locations

SEQ ID NO: 12005 - protein, 506 aa, Zea mays; identical to SEQ ID NO: 11381
  misc_feature (506)..(506): Xaa can be any naturally occurring amino acid
  unsure (1)..(506): unsure at all Xaa locations

SEQ ID NO: 12006 - protein, 166 aa, Zea mays; identical to SEQ ID NO: 9961
  misc_feature (166)..(166): Xaa can be any naturally occurring amino acid
  unsure (1)..(166): unsure at all Xaa locations

SEQ ID NO: 12007 - protein, 501 aa, Zea mays; identical to SEQ ID NO: 10579
  misc_feature (501)..(501): Xaa can be any naturally occurring amino acid
  unsure (1)..(501): unsure at all Xaa locations

SEQ ID NO: 12008 - protein, 289 aa, Zea mays; identical to SEQ ID NO: 10780
  misc_feature (289)..(289): Xaa can be any naturally occurring amino acid
  unsure (1)..(289): unsure at all Xaa locations

SEQ ID NO: 12009 - protein, 249 aa, Zea mays; identical to SEQ ID NO: 9907

SEQ ID NO: 12010 - protein, 303 aa, Zea mays; identical to SEQ ID NO: 9889
  misc_feature (303)..(303): Xaa can be any naturally occurring amino acid
  unsure (1)..(303): unsure at all Xaa locations

SEQ ID NO: 12011 - protein, 304 aa, Zea mays
  misc_feature (304)..(304): Xaa can be any naturally occurring amino acid
  unsure (1)..(304): unsure at all Xaa locations
RMGGFVKTHKSNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSEYIKKGVEAEEIEALYKKVHAAIRADPSVVKSTKQPPKEHKRYNPKKLTYEQRKASLIERLNQLNSSGGADDDDEDDEX

SEQ ID NO: 12012 - protein, 264 aa, Zea mays
  misc_feature (264)..(264): Xaa can be any naturally occurring amino acid
  unsure (1)..(264): unsure at all Xaa locations
CPRPQRLASAALPLSRDPRDRNRGAPPPSSKMAPSLLGGFTKSLAMTVLSEIGDKTFFAAAILAMRHPRKLVLAGCLTALIVMTALSASLGWVAPNLISRKWTHHLTTLLFFLFGIWSLWEGFKEDGDSEELAEVEAELDAAFKSNKGESKNKFKANDDMKKQQRPFLMQFFSPIFLKAFSITFFGEWGDKSQIATIGLAADENPFGVVLGGIIAQALCTTAAVLGGKSLASQISEKMVELSSGVLFLLFGIMSLLSGPEGELX

SEQ ID NO: 12013 - protein, 214 aa, Zea mays
  misc_feature (214)..(214): Xaa can be any naturally occurring amino acid
  unsure (1)..(214): unsure at all Xaa locations
RGRILSPSAVFPKSSKPQSLNPRRRPHDAHLRSRGGSMSRHPITKWAQRSDRVFLTIELPDAKDVKLNLKSEGHFNFSAKGSDDLPYEFDIELFDAVNVEESKAAVAPRTICYLIKKAKSGWWPRLLKQEGKPPVFLKVDWDKWQDEDDEDAGFNDFGGMDFSKLDIGGADDDDIGDDEDDVVESANKDEQGGKTEESKEEEAAPAAAEEVKPX

SEQ ID NO: 12014 - protein, 267 aa, Zea mays
  misc_feature (267)..(267): Xaa can be any naturally occurring amino acid
  unsure (1)..(267): unsure at all Xaa locations
LINQDKNKYNTPKYRFVVRFTNKDITAQIISASIAGDMVLASAYSHELPRYGLEVGLTNYAAAYCTGLLLARRVLKIRGLDQEYEGNVEATGEDFSVEPADERRPFRALLDVGLIRTTTGNRVFGALKGALDGGLDIPHSEKRFAGFKKDDKQLDADTHRRYIYGGHVADYMKNLAEEEPEKYQSHFSAYIKKGVEADEIEALYKKVHAAIRADPSIVKSTKQPPKEHKRYNPKKLTYEQRKASLIERLNQLNSSGGADDDDEDDEX

SEQ ID NO: 12015 - protein, 164 aa, Zea mays; identical to SEQ ID NO: 10578
  misc_feature (164)..(164): Xaa can be any naturally occurring amino acid
  unsure (1)..(164): unsure at all Xaa locations

SEQ ID NO: 12016 - protein, 341 aa, Zea mays
  misc_feature (341)..(341): Xaa can be any naturally occurring amino acid
  unsure (1)..(341): unsure at all Xaa locations
MTAGFQLGVIGSLTLSVASSVAIVICNKALISTLGFPFATTLTSWHLMVTFCTLHVAQRLRFFEPKAIDGQTVVLFGLLNGTSIGLLNLSLGFNSIGFYQMTKLAIIPFTVLLETIFLKKRFSETIKFSLLVLLLGVGIASVTDLKLNCLGSVLSGLAIATTCVGQILTNTIQRKLKVSSTQLLYQSAPYQAAILFATGPFVDHLLTGRSVFAHRYTFPVVGFIVLSCLIAVSVNFSTFLVIGTTSPVTYQVLGHLKTCLVLSFGYTLLHDPFTVRNILGILVAIFGMALYSIFSVREGKKKSAGDALPVSQMPDKETEPLLATKDNSDTKKANGVAHDCX

SEQ ID NO: 12017 - protein, 444 aa, Zea mays
  misc_feature (444)..(444): Xaa can be any naturally occurring amino acid
  unsure (1)..(444): unsure at all Xaa locations
MVSPGSNRGGLSRVSTRGGVAGPGSPRASPAATAFAALRRRWRWAPPGSSTLERAARAFLLASAALVLSCALYLYVLRYVGRGGRAFAAAGFVGDAVLGLGGEPCDVFDGAWVPDDTGLRPLYNSSGCPFAERGFDCLANGRNDTGYLKWRWKPRRCGVPRFAARTALERLRGKRVVFVGDSMSRSQWESFICMLMAGVDDPRTVFEVNGNEITKTIRHLAVRFASHGLTVEFFRSVFLVQEHPAPRHAPKRVKSTLRLDRMDNFSRKWVNSDVLIFNTGHWWTPTKLFDTGCYFQAGRSLKLGTSIDAGFRMALETWASWVQKRVDLNRTHVFFRTYEPSHWGDTSQKVCEVTEQPSSEAKGNDKSEFGAILADVVTNMKVPITVLNVTLMGSFRSDAHVGTWSYPPTILDCSHWCLPGVPDAWNELVFSYLLTNGWRNMAGX

SEQ ID NO: 12018 - protein, 381 aa, Zea mays
  misc_feature (381)..(381): Xaa can be any naturally occurring amino acid
  unsure (1)..(381): unsure at all Xaa locations
ELASQQRVASSASKAPSARPASFAMNMGGRSPAATTIRCKYCSASLTVCAGERAIQCAQCCGVTRIRRSLSSRLPLPALTRPASVAGFPPCGGRGKKRAVLIGITYGGARRGCGELRGPINDVKCMRQLLCQRFAFPSDGIIMLTDDQKDPFRVPTKDNIRMAMQWLVQGCSSGDSLVFHFSGLGAQVADADCDEQDGYDEAICPVDSFQKGPILDDEINETIVRPLVPGAKLHAVVDACHSDSVLDLPFLCNMSRTGNWQWEDHRPPSGVCKGTSGGQAVLISGYSDGKSKFSMTPEACAAVGAMTHSFIKAVECEPQGVTYGRLLTSMKAIMTNAGGCNQQLQGACAPARKVVNFSGVQEPNLSCSEMFDVYRKPFALX

SEQ ID NO: 12019 - protein, 397 aa, Zea mays
  misc_feature (397)..(397): Xaa can be any naturally occurring amino acid
  unsure (1)..(397): unsure at all Xaa locations
LRLRPSLLPVRPGAARPRDHFLPPCCSIQRNGEGRICFSSQRTQGPTLHHHQKFFEWKSSYCRISHRSLNTSVNASGQQLQSEPETHDSTTIWRAISSSLDAFYRFSRPHTVIGTALSIVSVSLLAVQSLSDISPLFLTGLLEAVVAALFMNIYIVGLNQLFDIEIDKVNKPTLPLASGEYTLATGVAIVSVFAAMSFGLGWAVGSQPLFWALFISFVLGTAYSINLPYLRWKRFAVVAALCILAVRAVIVQLAFFLHIQTFVFRRPAVFSRPLLFATGFMTFFSVVIALFKDIPDIEGDRIFGIRSFSVRLGQKKVFWICVGLLEMAYSVAILMGATSSCLWSKTATIAGHSILAAILWSCARSVDLTSKAAITSFYMFIWKLFYAEYLLIPLVRX

SEQ ID NO: 12020 - protein, 765 aa, Zea mays
  misc_feature (765)..(765): Xaa can be any naturally occurring amino acid
  unsure (1)..(765): unsure at all Xaa locations
RTWLRSAGSTDSTAWFERLPPLHILPPCLPVPGVTGVRAIPRSRGSCASGDQRSCSSSPPGAAVPASQPAAAAAAAVSELELLVPRGRGAGAMDQLRPEPAAGAHEIEKTAAPDVESEPAAAVPEPERVPPWREQVTARGMVAALLIGFVYTVIIMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKVALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGSX

SEQ ID NO: 12021 - protein, 648 aa, Zea mays
  misc_feature (648)..(648): Xaa can be any naturally occurring amino acid
  unsure (1)..(648): unsure at all Xaa locations
FTPNPNPDPRMLGRAAALSAPRWRGGVPDLRAALRSGGNLLFALFVAAVLAFTLLAAFHSPDDPLLHPSSHQLTDFLTSATSTSTFLTDDSVLRTGEDFNSSSTGAAGEVAAGGVEVVAEAVPFIKLSEVGAEAEKTEPETERAVTVDTDAATGEGAAVAEETAVAEAVSCDTEAPVDCTGDRELFNLLMRAAIERFPDLHFYRFGRPVAVPGSPMECDLAWRFRPAADAIGTGRTTYYKDYRRFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERDFRLYFDFEHLKQSASVIDQSQFWQDWGQWHKKDRLKNFYTEDIRMTPMKLRDIKDTLIMRKFGNVEPDNYWSRVCEGETEGIIKRPWHFLWKSRRLMEIVSAIASRMNWDFDSVHVVRGEKAQNTQLWPNLDRDTSPDSLLMALNDKVGAGRYLYIATNEPDKSFFNPLKEKYKTHFLDDFKYLWDENSEWFTETKELSNGQPVEFDGYMRIAVDTEVFLRGKRHVETFNELTRDCKDGVNTCSASSX

SEQ ID NO: 12022 - protein, 407 aa, Zea mays
  misc_feature (407)..(407): Xaa can be any naturally occurring amino acid
  unsure (1)..(407): unsure at all Xaa locations
GASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPYX

SEQ ID NO: 12023 - protein, 333 aa, Zea mays; identical to SEQ ID NO: 11319

SEQ ID NO: 12024 - protein, 301 aa, Zea mays; identical to SEQ ID NO: 10913
  misc_feature (301)..(301): Xaa can be any naturally occurring amino acid
  unsure (1)..(301): unsure at all Xaa locations

SEQ ID NO: 12025 - protein, 447 aa, Zea mays
  misc_feature (447)..(447): Xaa can be any naturally occurring amino acid
  unsure (1)..(447): unsure at all Xaa locations
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPYX

SEQ ID NO: 12026 - protein, 408 aa, Zea mays
  misc_feature (408)..(408): Xaa can be any naturally occurring amino acid
  unsure (1)..(408): unsure at all Xaa locations
MASLCDFCGKQRSMIYCRSDAASLCLSCDRNVHSANALSRRHTRTLLCDRCGSQPASVRCLEDNASLCQNCDWNGHDAESGASGHKRQAINCYSGCPSSAELSRIWSFITDIPTVAAEPDYEDGLSMMTIDGSDVTNRHDTSDDKRLLEIANTTLMSDPPSADKLKSPTGSSSGDGFDVMTLATDQPAGPVSATPKVPNARDDDKFNDGMYEDLCVDDADLTFEDYEELFGTSHIRTEELFDDAGIDGYFELKETPPFYFNEQPKAMQIECGNVVSADCAMSNPGARADSSLCIPVRQVRSSISHSLSGLTGESSAGDHHDCGVSPMLLMGEPPWHSPGGPEGSVAGGSRDSALTRYKEKKKRRKFDKKIRYASRKARADVRKRVKGRFIKAGEAYDYDPLSQTRSYX

SEQ ID NO: 12027 - protein, 444 aa, Zea mays
  misc_feature (444)..(444): Xaa can be any naturally occurring amino acid
  unsure (1)..(444): unsure at all Xaa locations
PIPPSILSDPTLAAAATSLLPANYNFELHKTAHRIRSAAARRVALQLPEGLLLFALPLSHLLAPYLEPGADNDVLVLADATYGACCLADRPARALAADLLVHYGHSCLVPVTASLLPVLYVFVEIRVDAARLAAAVRAAFPDPAAAPRLAIAGTVQFIAAVHAAREMLTVEGYHDIVVPQAKPLSAGEILGCTAPTLKKSEEVGAVVFVADGRFHLEAFMIANPGVKAYRFDPFLGVLVLEEYDHVGMKQARKAAVLAARKAKSWGVVLGTLGRQGSTKVLDRVVEHLEEKELEHTVVLMSELSPARMELFGDSIDAWVQIACPRLSIDWGEGFKKPVLTTFEFDVALGYVPGWWEKGSRGCGSECGVGCCSGSGTRGNCNCSDGDYGGDYPMDYYSQDGGDWNSCYMKKKPSTGERKLRVRIGNEIQAEEKRGNQDSRELVRX

SEQ ID NO: 12028 - protein, 491 aa, Zea mays
  misc_feature (491)..(491): Xaa can be any naturally occurring amino acid
  unsure (1)..(491): unsure at all Xaa locations
SMDYLAAAVPVTLALGVGAILLVLRWTYCRRRTSAEEARLPPGSRGLLFLGETLHYLAASSTPGVLPPFFQRRLERYGPIFRTNLVGEDLVVSLDAELNAHVLKQEERGFQIWYPPSFMRVFGADNITAKLGVLHRHMRTLVLRLFGHQTVRSVLLHDVQRSARDELRSWLGRPDVEVRTATSRMIFGVTANKLISHDDAASGGTLWRCFHDWTSGLLSFPVSIPGTTFYRCMQGRKKVMTMLKQQLVERRRNAAERETTEDFFDLVIDELNKPDPMMDESTALDLLFTMLFASHETTSMVLTVILKYLTDNPKALQELTEEHERILESRADPGSDLTWEEYRSMKFTSHVIHESLRLANIALAMFRKANQDVHINGYTIPKGSKIMMCALASHLNTEVYEDPSVFNPWRWKDIPEPVGTSKDFMAFGGGLRLCAGAEFSKMQMAMFLHYLVTNYSWKPVSGGTMLFYPGLQFPEGFHIQLLPKIPNVVPX

SEQ ID NO: 12029 - protein, 525 aa, Zea mays
  misc_feature (525)..(525): Xaa can be any naturally occurring amino acid
  unsure (1)..(525): unsure at all Xaa locations
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHVX

SEQ ID NO: 12030 - protein, 394 aa, Zea mays; identical to SEQ ID NO: 11877
  misc_feature (394)..(394): Xaa can be any naturally occurring amino acid
  unsure (1)..(394): unsure at all Xaa locations

SEQ ID NO: 12031 - protein, 521 aa, Zea mays
  misc_feature (521)..(521): Xaa can be any naturally occurring amino acid
  unsure (1)..(521): unsure at all Xaa locations
MAAAPPPKADELQPFPPKEQLPGVAFCITSPPPWPEAILLGFQHFVVMLGTTVIIPSALVPQMGGGNEEKARVVQTILFVAGINTLFQTLFGTRLPVVMGGSYVFVGPTISIVLAGRYSNEADPHEGALLVASTIQIILGFSGLWRNVVKLLSPLAAVPLVSLVGFGLYELGFPGVAKCVEVGLPELLLLVVFSQYLPQVLDFGKSVFSRFSVLFTVAIVWLYAYILTIGGAYKNSPPKTQVHCRVDRSGLISGAPWISVPYPFQWGAPTFDAGEAFAMMMTSFIALVESTGAFIGASRYASATMIPPSIISRGVGWQGIGLLLDSFFGTANGTSVSVENIGLLALTRIGSRRVVQISAGFMIFFSVLGKFGALFASIPLPVFAGMYCLFFAYVGGVGLSLLQFCNLNSFRTKFIMGFAFFMGLSVPQYFNEYTAVASYGPVHTGARWFNDMINVPFTSKPFVAGLVAYILDNTLQVKESAVRKDRGNHWWEKFRSFKKDARSQEFYSLPFNLNKFFPSVX

SEQ ID NO: 12032 - protein, 401 aa, Zea mays; identical to SEQ ID NO: 10260
  misc_feature (401)..(401): Xaa can be any naturally occurring amino acid
  unsure (1)..(401): unsure at all Xaa locations

SEQ ID NO: 12033 - protein, 336 aa, Zea mays
  misc_feature (336)..(336): Xaa can be any naturally occurring amino acid
  unsure (1)..(336): unsure at all Xaa locations
MADLIKAVDIRGGKGERDALFINPQTPKPSPTEGQALVRVKAFGINRMDIVQRRGFYPLPPQAPATLGVEFSGTIESLGPGDHGAFKQGDEVFGLAYGGAYAEYLAVSTRMLLHKPSSMDFVTCAGIPETWITATQALHLVLGFTKGKSILWHAGASGVSIAGIQLSKIAGASQVFATAGSQEKCDFITSKLGATAAFNYKTQDWAEEIKKHTDGNGVDYIVDFVGASYFQQNQTAAARDGRIVLLGTLGGVKIPEADISQILYKRLRIEGSTLRSRDEEYQGKLRDRLEEYLPDFESGKLKILVDKVLPWEEIQEAHKHMEEAKNLGKIICTISX

SEQ ID NO: 12034 - protein, 186 aa, Zea mays
MASHQDKASYQAGETKARTELDVQEKTGQAVGATKDTAQHAKDRAADAAGHAAGKGQDAKEATKQKASDTGSYLGKKTDEAKHKAGETTEATKQKAGETTEAAKQKAADAMEAAKQKAAEAGQYAKDTAVSGKDKSGGVIQQATEQVKSAAAGAKDAVMSTLGMGGDDKQGDANTNKDSSTITRDH

SEQ ID NO: 12035 - protein, 178 aa, Zea mays
  misc_feature (178)..(178): Xaa can be any naturally occurring amino acid
  unsure (1)..(178): unsure at all Xaa locations
MFNMSRDPLVVGNVVGDIVDPFITTASLRVFYNNKEMTNGSELKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIRX

SEQ ID NO: 12036 - protein, 257 aa, Zea mays; identical to SEQ ID NO: 10038
  misc_feature (257)..(257): Xaa can be any naturally occurring amino acid
  unsure (1)..(257): unsure at all Xaa locations

SEQ ID NO: 12037 - protein, 327 aa, Zea mays
  misc_feature (327)..(327): Xaa can be any naturally occurring amino acid
  unsure (1)..(327): unsure at all Xaa locations
VDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVKX

SEQ ID NO: 12038 - protein, 254 aa, Zea mays
  misc_feature (254)..(254): Xaa can be any naturally occurring amino acid
  unsure (1)..(254): unsure at all Xaa locations
RIHAGSRPVNSNSLAFLLTVLVLFMVLNSHQISPNLLLWLVLGVFLMATSLRMYATCQQLAHAAAANSFLGHTELRVHVPPSITLATRGRLQSLRLQLALLDREFDDLDYDTLRALDADNSPHAPSMSEEEINSLPVFKYKVQAQQRHPPARKSDGPSQLSVSSTGSGNEEKQDGLKADGTSKTSEDELTCSVCLEQVTVGDLLRSLPCLHQFHVNCIDPWLRQQGTCPICKHQVSDGWHATGNGEEDASYMVX

SEQ ID NO: 12039 - protein, 417 aa, Zea mays
  misc_feature (417)..(417): Xaa can be any naturally occurring amino acid
  unsure (1)..(417): unsure at all Xaa locations
DEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLARFKSIPSIVELDSLKVSGDVWFGSGITLKGKVTIIAKPGVKLEIPDGDVLENKDVNGPEDLX

SEQ ID NO: 12040 - protein, 405 aa, Zea mays
  misc_feature (405)..(405): Xaa can be any naturally occurring amino acid
  unsure (1)..(405): unsure at all Xaa locations
EQTARDDGIIKNGREILFQAFNWESNKHNWWSILEEKVTDLAESGFTSVWLPPPTQSLSREGYLPQNLYCLDSCYGSLHELKLLLHKMSEHNVRAMADVVINHRIGTTQGSNGMYNRYDGIPISWDEHAVTSCSGGKGNKSTGDNFDGVPNIDHTQPFVRKDIIEWLISLRKSVGFQDFRFDFTKGYAAKFVKEYIEESKPLFAVGEYWDSCEYSPPDYRLNYNQDIHRQRIINWIDNTGGLCAAFDFTTKGILQEAVKGELWRLRDSEGKPPGVMGWWPSRSVTFIENHDTGSTQGHWPFPSDHIMEGYAYILTHPGIPTVFYDHFYDQGVPLHDEIAKLMQIRKCQDIHSRSSIKILEVGSDLYSAIIDDKLCMKIGDGSWCPSDPEWRLAVSGDRYAVWHKX

SEQ ID NO: 12041 - protein, 336 aa, Zea mays
  misc_feature (336)..(336): Xaa can be any naturally occurring amino acid
  unsure (1)..(336): unsure at all Xaa locations
SNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMINLEMCMTGLDKKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDEX

SEQ ID NO: 12042 - protein, 192 aa, Zea mays
  misc_feature (192)..(192): Xaa can be any naturally occurring amino acid
  unsure (1)..(192): unsure at all Xaa locations
HDRAHNHEDSFIRRNHKPPSRASIMEYGQQGQRGHGATGHVDQYGNPVGGVEHGTGGMRHGTGTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQHX

SEQ ID NO: 12043 - protein, 457 aa, Zea mays
  misc_feature (457)..(457): Xaa can be any naturally occurring amino acid
  unsure (1)..(457): unsure at all Xaa locations
RGLVFSEDSAMAVTIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLQTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPYX

SEQ ID NO: 12044 - protein, 252 aa, Zea mays
  misc_feature (252)..(252): Xaa can be any naturally occurring amino acid
  unsure (1)..(252): unsure at all Xaa locations
LDNSSSIVSEKGSNPNRNSLRGFEVIDQIKAALEAACPGTVSCADIVALAARDSTALVGGPYWDVPLGRRDSLGASIQGSNNDIPAPNNTLPTIITKFKRQGLNVVDVVALSGGHTIGMSRCTSFRQRLYNQTGNGMADSTLDVSYAAQLRQGCPRSGGDNNLFPLDFITPAKFDNFYYKNLLAGKGLLSSDEILLTKSAETAALVKAYAADVNLFFQHFAQSMVNMGNISPLTGSQGEIRKNCRRLNNDHX

SEQ ID NO: 12045 - protein, 241 aa, Zea mays
  misc_feature (241)..(241): Xaa can be any naturally occurring amino acid
  unsure (1)..(241): unsure at all Xaa locations
MMEGGSRADGRNPNQLRPFTCTGNPLHRAHGSARWAQGDTVVLAAVYGPKPGTRKGENPEKASIEVVWKPKTGQIGRQEREYEMTLKRTLQSICLLTVHPNTTTSVVLQVVGDDGSLMSCAINASCAALAFAGIPMKHLAVAISCGVMDNGVVILDTSRAEEQQARSFAHLVFPNSRKSVESKDPTQRDEESERGLITCITHGAMSEDDYFNCIERGVMASSRISDFMRKTLQKEVSRDAX

SEQ ID NO: 12046 - protein, 180 aa, Zea mays
MASHQDKASYQAGETKARTEEKTGQAVGATKDTAQHAKDRAADAAGHAAGKGQDAKEATKQKASDTGSYLGKKTDEAKHKAGETTEATKQKASETTEATKQKAGETTEAARQKAADAMEAAKQKAAEAGQYAKDTAVSGKDKSGGVIQQATEQVKSAAAGAKDAVMSTLGMGGDDKQGDA
